United States Patent 7,323,308 (METHODS OF GENETIC ANALYSIS OF E. COLI) - sequence listing, part 6

SEQ ID NO: 205562 - DNA, 25 bp, E. coli
taaaggctttggtggactgtatgga

SEQ ID NO: 205563 - DNA, 25 bp, E. coli
tagtggctgggttcgaggattttaa

SEQ ID NO: 205564 - DNA, 25 bp, E. coli
tagtggctgggtacgaggattttaa

SEQ ID NO: 205565 - DNA, 25 bp, E. coli
actgtatggatgatgagacgagtca

SEQ ID NO: 205566 - DNA, 25 bp, E. coli
actgtatggatgttgagacgagtca

SEQ ID NO: 205567 - DNA, 25 bp, E. coli
tagctgcggcaaaccataagcttcc

SEQ ID NO: 205568 - DNA, 25 bp, E. coli
tacctgataaaatagatatcgcaca

SEQ ID NO: 205569 - DNA, 25 bp, E. coli
tacctgataaaaaagatatcgcaca

SEQ ID NO: 205570 - DNA, 25 bp, E. coli
tagctgcggcaatccataagcttcc

SEQ ID NO: 205571 - DNA, 25 bp, E. coli
tgtacagtttggtccatgagaatgg

SEQ ID NO: 205572 - DNA, 25 bp, E. coli
tgtacagtttggaccatgagaatgg

SEQ ID NO: 205573 - DNA, 25 bp, E. coli
tgagacgagtcagttattgtacagt

SEQ ID NO: 205574 - DNA, 25 bp, E. coli
tgagacgagtcacttattgtacagt

SEQ ID NO: 205575 - DNA, 25 bp, E. coli
gaagctatcctgtatgtattcccac

SEQ ID NO: 205576 - DNA, 25 bp, E. coli
gaagctatcctgaatgtattcccac

SEQ ID NO: 205577 - DNA, 25 bp, E. coli
cccaaatatgcggaagctatcctga

SEQ ID NO: 205578 - DNA, 25 bp, E. coli
cccaaatatgcgcaagctatcctga

SEQ ID NO: 205579 - DNA, 25 bp, E. coli
tagaaaaaatgaagcggtaaaggct

SEQ ID NO: 205580 - DNA, 25 bp, E. coli
tagaaaaaatgatgcggtaaaggct

SEQ ID NO: 205581 - DNA, 25 bp, E. coli
taataagatactggtgtgggcggct

SEQ ID NO: 205582 - DNA, 25 bp, E. coli
taataagatactcgtgtgggcggct

SEQ ID NO: 205583 - DNA, 25 bp, E. coli
caaacgttagcgagcaggcattcaa

SEQ ID NO: 205584 - DNA, 25 bp, E. coli
caaacgttagcgtgcaggcattcaa

SEQ ID NO: 205585 - DNA, 25 bp, E. coli
tacatcaacgcatctgagccgaagc

SEQ ID NO: 205586 - DNA, 25 bp, E. coli
tacatcaacgcaactgagccgaagc

SEQ ID NO: 205587 - DNA, 25 bp, E. coli
taaaagccgcatcgaaagtgcaatc

SEQ ID NO: 205588 - DNA, 25 bp, E. coli
taaaagccgcatggaaagtgcaatc

SEQ ID NO: 205589 - DNA, 25 bp, E. coli
agtagttcttcgacctgaatcaggg

SEQ ID NO: 205590 - DNA, 25 bp, E. coli
agtagttcttcgtcctgaatcaggg

SEQ ID NO: 205591 - DNA, 25 bp, E. coli
tatcacaaacgaagaagccgaacgc

SEQ ID NO: 205592 - DNA, 25 bp, E. coli
tatcacaaacgatgaagccgaacgc

SEQ ID NO: 205593 - DNA, 25 bp, E. coli
tgaacataatgaaggaggccaccgc

SEQ ID NO: 205594 - DNA, 25 bp, E. coli
tgaacataatgatggaggccaccgc

SEQ ID NO: 205595 - DNA, 25 bp, E. coli
tccagtctggtgtagaaatcccata

SEQ ID NO: 205596 - DNA, 25 bp, E. coli
tccagtctggtgaagaaatcccata

SEQ ID NO: 205597 - DNA, 25 bp, E. coli
ccaacaaaagtcgaaggcaaggcta

SEQ ID NO: 205598 - DNA, 25 bp, E. coli
gctcgcctcttaacggtagtccaag

SEQ ID NO: 205599 - DNA, 25 bp, E. coli
gctcgcctcttatcggtagtccaag

SEQ ID NO: 205600 - DNA, 25 bp, E. coli
ccaacaaaagtccaaggcaaggcta

SEQ ID NO: 205601 - DNA, 25 bp, E. coli
cttgatgtgaatcagcttgccgagc

SEQ ID NO: 205602 - DNA, 25 bp, E. coli
cttgatgtgaatgagcttgccgagc

SEQ ID NO: 205603 - DNA, 25 bp, E. coli
ggaaaaagatttcactggcgaacca

SEQ ID NO: 205604 - DNA, 25 bp, E. coli
ggaaaaagatttgactggcgaacca

SEQ ID NO: 205605 - DNA, 25 bp, E. coli
caaatattatattagatctgctgct

SEQ ID NO: 205606 - DNA, 25 bp, E. coli
cactggcgcatggagaataagttgc

SEQ ID NO: 205607 - DNA, 25 bp, E. coli
cactttctctcattaatagcagagc

SEQ ID NO: 205608 - DNA, 25 bp, E. coli
cactggcgcatgcagaataagttgc

SEQ ID NO: 205609 - DNA, 25 bp, E. coli
caaatattatataagatctgctgct

SEQ ID NO: 205610 - DNA, 25 bp, E. coli
cactttctctcaataatagcagagc

SEQ ID NO: 205611 - DNA, 25 bp, E. coli
taaatcgaaatcactggcgcatgga

SEQ ID NO: 205612 - DNA, 25 bp, E. coli
taaatcgaaatctctggcgcatgga

SEQ ID NO: 205613 - DNA, 25 bp, E. coli
agaagttcgccagagtaaatcgaaa

SEQ ID NO: 205614 - DNA, 25 bp, E. coli
agaagttcgccacagtaaatcgaaa

SEQ ID NO: 205615 - DNA, 25 bp, E. coli
tagcagagcaaatgaaagaatccga

SEQ ID NO: 205616 - DNA, 25 bp, E. coli
tagatctgctgcattaaccgcagag

SEQ ID NO: 205617 - DNA, 25 bp, E. coli
tagcagagcaaaagaaagaatccga

SEQ ID NO: 205618 - DNA, 25 bp, E. coli
tagatctgctgctttaaccgcagag

SEQ ID NO: 205619 - DNA, 25 bp, E. coli
gaaagaatccgaaatgacgatcaaa

SEQ ID NO: 205620 - DNA, 25 bp, E. coli
gaaagaatccgatatgacgatcaaa

SEQ ID NO: 205621 - DNA, 25 bp, E. coli
tggcagtccactttctctcaataat

SEQ ID NO: 205622 - DNA, 25 bp, E. coli
tggcagtccactatctctcaataat

SEQ ID NO: 205623 - DNA, 25 bp, E. coli
taagttgcacagtagcctgatgtgg

SEQ ID NO: 205624 - DNA, 25 bp, E. coli
taagttgcacagaagcctgatgtgg

SEQ ID NO: 205625 - DNA, 25 bp, E. coli
gagaataagttggacagtagcctga

SEQ ID NO: 205626 - DNA, 25 bp, E. coli
gagaataagttgcacagtagcctga

SEQ ID NO: 205627 - DNA, 25 bp, E. coli
aattcgtaccatcctggccgaagcg

SEQ ID NO: 205628 - DNA, 25 bp, E. coli
aattcgtaccatgctggccgaagcg

SEQ ID NO: 205629 - DNA, 25 bp, E. coli
cggcgtatagcccaattcgtaccat

SEQ ID NO: 205630 - DNA, 25 bp, E. coli
cggcgtatagccgaattcgtaccat

SEQ ID NO: 205631 - DNA, 25 bp, E. coli
attgtggaacgtggcagcgcggcgt

SEQ ID NO: 205632 - DNA, 25 bp, E. coli
attgtggaacgtcgcagcgcggcgt

SEQ ID NO: 205633 - DNA, 25 bp, E. coli
tagcgaacaacatcgcgttgggttg

SEQ ID NO: 205634 - DNA, 25 bp, E. coli
tagtgataaggtcccagaaggtcgt

SEQ ID NO: 205635 - DNA, 25 bp, E. coli
tagtgataaggtgccagaaggtcgt

SEQ ID NO: 205636 - DNA, 25 bp, E. coli
tagcgaacaacaacgcgttgggttg

SEQ ID NO: 205637 - DNA, 25 bp, E. coli
ttttccgacaccctagcgaacaaca

SEQ ID NO: 205638 - DNA, 25 bp, E. coli
ttttccgacaccgtagcgaacaaca

SEQ ID NO: 205639 - DNA, 25 bp, E. coli
ccagtcgttattgatggtagtgata

SEQ ID NO: 205640 - DNA, 25 bp, E. coli
ccagtcgttattcatggtagtgata

SEQ ID NO: 205641 - DNA, 25 bp, E. coli
gaatattcgccagtttacgtatccg

SEQ ID NO: 205642 - DNA, 25 bp, E. coli
gaatattcgccactttacgtatccg

SEQ ID NO: 205643 - DNA, 25 bp, E. coli
cccggtcagatgctaggtatttgcg

SEQ ID NO: 205644 - DNA, 25 bp, E. coli
cccggtcagatggtaggtatttgcg

SEQ ID NO: 205645 - DNA, 25 bp, E. coli
ggccgaagcgcctgtcgttattgat

SEQ ID NO: 205646 - DNA, 25 bp, E. coli
ggtgaactggatgtgaatattcgcc

SEQ ID NO: 205647 - DNA, 25 bp, E. coli
ggtgaactggatctgaatattcgcc

SEQ ID NO: 205648 - DNA, 25 bp, E. coli
ggccgaagcgccagtcgttattgat

SEQ ID NO: 205649 - DNA, 25 bp, E. coli
catcaacgacgactaccgcattgac

SEQ ID NO: 205650 - DNA, 25 bp, E. coli
catcaacgacgagtaccgcattgac

SEQ ID NO: 205651 - DNA, 25 bp, E. coli
taccaaacccgtatgttaaagcatc

SEQ ID NO: 205652 - DNA, 25 bp, E. coli
taccaaacccgtttgttaaagcatc

SEQ ID NO: 205653 - DNA, 25 bp, E. coli
cgacgactaccggattgactacctg

SEQ ID NO: 205654 - DNA, 25 bp, E. coli
agaagatggcaggatcaacgacgac

SEQ ID NO: 205655 - DNA, 25 bp, E. coli
cgacgactaccgcattgactacctg

SEQ ID NO: 205656 - DNA, 25 bp, E. coli
agaagatggcagcatcaacgacgac

SEQ ID NO: 205657 - DNA, 25 bp, E. coli
agatggcagcatcaacgacgactac

SEQ ID NO: 205658 - DNA, 25 bp, E. coli
agatggcagcatgaacgacgactac

SEQ ID NO: 205659 - DNA, 25 bp, E. coli
aaacccgtatgtaaaagcatctgac

SEQ ID NO: 205660 - DNA, 25 bp, E. coli
aaacccgtatgttaaagcatctgac

SEQ ID NO: 205661 - DNA, 25 bp, E. coli
tttgaaggcagcgtaccaaacccgt

SEQ ID NO: 205662 - DNA, 25 bp, E. coli
tttgaaggcagcctaccaaacccgt

SEQ ID NO: 205663 - DNA, 25 bp, E. coli
tttaccgatgtgcagctacgcggct

SEQ ID NO: 205664 - DNA, 25 bp, E. coli
tttaccgatgtggagctacgcggct

SEQ ID NO: 205665 - DNA, 25 bp, E. coli
tgaaggcagcgtaccaaacccgtat

SEQ ID NO: 205666 - DNA, 25 bp, E. coli
tgaaggcagcgttccaaacccgtat

SEQ ID NO: 205667 - DNA, 25 bp, E. coli
tggttttgaagggagcgtaccaaac

SEQ ID NO: 205668 - DNA, 25 bp, E. coli
tggttttgaaggcagcgtaccaaac

SEQ ID NO: 205669 - DNA, 25 bp, E. coli
gatgtgcagctacgcggctattacc

SEQ ID NO: 205670 - DNA, 25 bp, E. coli
gatgtgcagctaggcggctattacc

SEQ ID NO: 205671 - DNA, 25 bp, E. coli
cagcctggaactccgtgtctgtatt

SEQ ID NO: 205672 - DNA, 25 bp, E. coli
cagcctggaactgcgtgtctgtatt

SEQ ID NO: 205673 - DNA, 25 bp, E. coli
agggaatgaagtattgctgccggat

SEQ ID NO: 205674 - DNA, 25 bp, E. coli
agggaatgaagttttgctgccggat

SEQ ID NO: 205675 - DNA, 25 bp, E. coli
acgcagaggcacagcgccaccgggt

SEQ ID NO: 205676 - DNA, 25 bp, E. coli
actgcgtgtctgtattgctcacaaa

SEQ ID NO: 205677 - DNA, 25 bp, E. coli
actgcgtgtctgaattgctcacaaa

SEQ ID NO: 205678 - DNA, 25 bp, E. coli
acgcagaggcactgcgccaccgggt

SEQ ID NO: 205679 - DNA, 25 bp, E. coli
tattgctcacaattcaattcccgcc

SEQ ID NO: 205680 - DNA, 25 bp, E. coli
tattgctcacaaatcaattcccgcc

SEQ ID NO: 205681 - DNA, 25 bp, E. coli
tgtattgctcactaatcaattcccg

SEQ ID NO: 205682 - DNA, 25 bp, E. coli
tgtattgctcacaaatcaattcccg

SEQ ID NO: 205683 - DNA, 25 bp, E. coli
tgccggatggcggtgcacgcagagg

SEQ ID NO: 205684 - DNA, 25 bp, E. coli
tgccggatggcgctgcacgcagagg

SEQ ID NO: 205685 - DNA, 25 bp, E. coli
cctggaactgcgtgtctgtattgct

SEQ ID NO: 205686 - DNA, 25 bp, E. coli
cctggaactgcgagtctgtattgct

SEQ ID NO: 205687 - DNA, 25 bp, E. coli
gcgtgtctgtatagctcacaaatca

SEQ ID NO: 205688 - DNA, 25 bp, E. coli
gcgtgtctgtattgctcacaaatca

SEQ ID NO: 205689 - DNA, 25 bp, E. coli
gaactgcgtgtcagtattgctcaca

SEQ ID NO: 205690 - DNA, 25 bp, E. coli
gacagggaatgatgtattgctgccg

SEQ ID NO: 205691 - DNA, 25 bp, E. coli
gacagggaatgaagtattgctgccg

SEQ ID NO: 205692 - DNA, 25 bp, E. coli
gaactgcgtgtctgtattgctcaca

SEQ ID NO: 205693 - DNA, 25 bp, E. coli
aacgcattggacctgccggacacca

SEQ ID NO: 205694 - DNA, 25 bp, E. coli
taaaacgcatcttcccgacgatgat

SEQ ID NO: 205695 - DNA, 25 bp, E. coli
taaaacgcatctacccgacgatgat

SEQ ID NO: 205696 - DNA, 25 bp, E. coli
tacacgactattggccagaagtgct

SEQ ID NO: 205697 - DNA, 25 bp, E. coli
tacacgactattcgccagaagtgct

SEQ ID NO: 205698 - DNA, 25 bp, E. coli
aacgcattggacgtgccggacacca

SEQ ID NO: 205699 - DNA, 25 bp, E. coli
taggaggtatctccaaagggctttt

SEQ ID NO: 205700 - DNA, 25 bp, E. coli
taggaggtatctgcaaagggctttt

SEQ ID NO: 205701 - DNA, 25 bp, E. coli
tgccggacaccagataggaggtatc

SEQ ID NO: 205702 - DNA, 25 bp, E. coli
tccctcggcactgcaagaggcgtta

SEQ ID NO: 205703 - DNA, 25 bp, E. coli
tgccggacaccacataggaggtatc

SEQ ID NO: 205704 - DNA, 25 bp, E. coli
tccctcggcactccaagaggcgtta

SEQ ID NO: 205705 - DNA, 25 bp, E. coli
tcttacagtaaatcgcatcttcccg

SEQ ID NO: 205706 - DNA, 25 bp, E. coli
tcttacagtaaaacgcatcttcccg

SEQ ID NO: 205707 - DNA, 25 bp, E. coli
gcgaatcggttgatccctcggcact

SEQ ID NO: 205708 - DNA, 25 bp, E. coli
gcgaatcggttgttccctcggcact

SEQ ID NO: 205709 - DNA, 25 bp, E. coli
ccgaaccaggcgtgacttagtcgat

SEQ ID NO: 205710 - DNA, 25 bp, E. coli
ccgacgatgatttgtggacaggagc

SEQ ID NO: 205711 - DNA, 25 bp, E. coli
ccgacgatgattagtggacaggagc

SEQ ID NO: 205712 - DNA, 25 bp, E. coli
ccgaaccaggcgagacttagtcgat

SEQ ID NO: 205713 - DNA, 25 bp, E. coli
gttgcgcgcattgctgacactgatg

SEQ ID NO: 205714 - DNA, 25 bp, E. coli
gttgcgcgcattcctgacactgatg

SEQ ID NO: 205715 - DNA, 25 bp, E. coli
aacattgagggcactggatggcaaa

SEQ ID NO: 205716 - DNA, 25 bp, E. coli
aacattgagggctctggatggcaaa

SEQ ID NO: 205717 - DNA, 25 bp, E. coli
taggaacaacattatacagcgtcgg

SEQ ID NO: 205718 - DNA, 25 bp, E. coli
taggaacaacataatacagcgtcgg

SEQ ID NO: 205719 - DNA, 25 bp, E. coli
tatgacttcgaaaaaagtagtgccc

SEQ ID NO: 205720 - DNA, 25 bp, E. coli
tatgacttcgaataaagtagtgccc

SEQ ID NO: 205721 - DNA, 25 bp, E. coli
tatcaaggccctatctcaaaattgg

SEQ ID NO: 205722 - DNA, 25 bp, E. coli
tttggcgcaccaaacacagattctg

SEQ ID NO: 205723 - DNA, 25 bp, E. coli
tattcaataggctaggacgagacct

SEQ ID NO: 205724 - DNA, 25 bp, E. coli
tatcaaggccctttctcaaaattgg

SEQ ID NO: 205725 - DNA, 25 bp, E. coli
tttggcgcaccatacacagattctg

SEQ ID NO: 205726 - DNA, 25 bp, E. coli
tattcaataggcaaggacgagacct

SEQ ID NO: 205727 - DNA, 25 bp, E. coli
gaatatccatgagcgtggagccatg

SEQ ID NO: 205728 - DNA, 25 bp, E. coli
gaatatccatgaccgtggagccatg

SEQ ID NO: 205729 - DNA, 25 bp, E. coli
gaactatctgaaaaaaggcactctg

SEQ ID NO: 205730 - DNA, 25 bp, E. coli
gaactatctgaataaaggcactctg

SEQ ID NO: 205731 - DNA, 25 bp, E. coli
tcagccttagaaatagacgacgcaa

SEQ ID NO: 205732 - DNA, 25 bp, E. coli
tcagccttagaattagacgacgcaa

SEQ ID NO: 205733 - DNA, 25 bp, E. coli
tgtcccaacaagagtaagaaacctg

SEQ ID NO: 205734 - DNA, 25 bp, E. coli
gagcatcgtatttttggtagcccta

SEQ ID NO: 205735 - DNA, 25 bp, E. coli
tgtcccaacaagtgtaagaaacctg

SEQ ID NO: 205736 - DNA, 25 bp, E. coli
gagcatcgtattattggtagcccta

SEQ ID NO: 205737 - DNA, 25 bp, E. coli
cagacgtcttctgcggtttctatga

SEQ ID NO: 205738 - DNA, 25 bp, E. coli
cagacgtcttctccggtttctatga

SEQ ID NO: 205739 - DNA, 25 bp, E. coli
tagtcttcggaagatcatcgcgcgc

SEQ ID NO: 205740 - DNA, 25 bp, E. coli
tagtcttcggaacatcatcgcgcgc

SEQ ID NO: 205741 - DNA, 25 bp, E. coli
tgaataaatgggagggtgacttgcc

SEQ ID NO: 205742 - DNA, 25 bp, E. coli
tgaataaatgggtgggtgacttgcc

SEQ ID NO: 205743 - DNA, 25 bp, E. coli
tgacctgacagatgtatcagacgtc

SEQ ID NO: 205744 - DNA, 25 bp, E. coli
tgacctgacagaagtatcagacgtc

SEQ ID NO: 205745 - DNA, 25 bp, E. coli
tctatgatagagcaattctgtggcg

SEQ ID NO: 205746 - DNA, 25 bp, E. coli
tctatgatagaggaattctgtggcg

SEQ ID NO: 205747 - DNA, 25 bp, E. coli
cctggacgagtttcgatgacctgac

SEQ ID NO: 205748 - DNA, 25 bp, E. coli
cctggacgagttacgatgacctgac

SEQ ID NO: 205749 - DNA, 25 bp, E. coli
gaatcagcgccatttatcacagaat

SEQ ID NO: 205750 - DNA, 25 bp, E. coli
gaatcagcgccaattatcacagaat

SEQ ID NO: 205751 - DNA, 25 bp, E. coli
cgcgcgctggcgttgattaatagct

SEQ ID NO: 205752 - DNA, 25 bp, E. coli
cgcgcgctggcgatgattaatagct

SEQ ID NO: 205753 - DNA, 25 bp, E. coli
ggtgacttgcctcaatataatccag

SEQ ID NO: 205754 - DNA, 25 bp, E. coli
ggtgacttgcctgaatataatccag

SEQ ID NO: 205755 - DNA, 25 bp, E. coli
taatagctaattcagtaaggccagg

SEQ ID NO: 205756 - DNA, 25 bp, E. coli
taatcaaaaccgctgacctggacga

SEQ ID NO: 205757 - DNA, 25 bp, E. coli
taatagctaattgagtaaggccagg

SEQ ID NO: 205758 - DNA, 25 bp, E. coli
taatcaaaaccggtgacctggacga

SEQ ID NO: 205759 - DNA, 25 bp, E. coli
caatgcctcttaaggttttcttaag

SEQ ID NO: 205760 - DNA, 25 bp, E. coli
caatgcctcttatggttttcttaag

SEQ ID NO: 205761 - DNA, 25 bp, E. coli
taaacaaaaccttaacaatgcctct

SEQ ID NO: 205762 - DNA, 25 bp, E. coli
taaacaaaacctaaacaatgcctct

SEQ ID NO: 205763 - DNA, 25 bp, E. coli
agtacgtgatttacttattgtcggg

SEQ ID NO: 205764 - DNA, 25 bp, E. coli
agtacgtgattttcttattgtcggg

SEQ ID NO: 205765 - DNA, 25 bp, E. coli
tattttctgacgttctccagtatgg

SEQ ID NO: 205766 - DNA, 25 bp, E. coli
tattttctgacgatctccagtatgg

SEQ ID NO: 205767 - DNA, 25 bp, E. coli
tgtacaaatgaccttgattgagaac

SEQ ID NO: 205768 - DNA, 25 bp, E. coli
tgtacaaatgacgttgattgagaac

SEQ ID NO: 205769 - DNA, 25 bp, E. coli
tgaagggagttgtatgtcaaagtga

SEQ ID NO: 205770 - DNA, 25 bp, E. coli
tgaagggagttgaatgtcaaagtga

SEQ ID NO: 205771 - DNA, 25 bp, E. coli
gccatctcctggtaatattttctga

SEQ ID NO: 205772 - DNA, 25 bp, E. coli
ccagtatggtcgtttaacttaaaca

SEQ ID NO: 205773 - DNA, 25 bp, E. coli
ccagtatggtcgattaacttaaaca

SEQ ID NO: 205774 - DNA, 25 bp, E. coli
gccatctcctggaaatattttctga

SEQ ID NO: 205775 - DNA, 25 bp, E. coli
gaaaagcgcacataatgtacaaatg

SEQ ID NO: 205776 - DNA, 25 bp, E. coli
gaaaagcgcacaaaatgtacaaatg

SEQ ID NO: 205777 - DNA, 25 bp, E. coli
gattgagaacgaattcagtacgtga

SEQ ID NO: 205778 - DNA, 25 bp, E. coli
gattgagaacgatttcagtacgtga

SEQ ID NO: 205779 - DNA, 25 bp, E. coli
taaggttcttctgaaagtgaaaagc

SEQ ID NO: 205780 - DNA, 25 bp, E. coli
taaggttcttctcaaagtgaaaagc

SEQ ID NO: 205781 - DNA, 25 bp, E. coli
caacgatgccagacggtttttcaat

SEQ ID NO: 205782 - DNA, 25 bp, E. coli
caacgatgccagtcggtttttcaat

SEQ ID NO: 205783 - DNA, 25 bp, E. coli
aagagtctacgcaggcgattcgtgc

SEQ ID NO: 205784 - DNA, 25 bp, E. coli
caatctggcatctccttgacgctca

SEQ ID NO: 205785 - DNA, 25 bp, E. coli
caatctggcatcaccttgacgctca

SEQ ID NO: 205786 - DNA, 25 bp, E. coli
aagagtctacgctggcgattcgtgc

SEQ ID NO: 205787 - DNA, 25 bp, E. coli
ttgctggcctggtccgcggttcgcc

SEQ ID NO: 205788 - DNA, 25 bp, E. coli
ttgctggcctggaccgcggttcgcc

SEQ ID NO: 205789 - DNA, 25 bp, E. coli
tcaggctatgcagtggctgacccgg

SEQ ID NO: 205790 - DNA, 25 bp, E. coli
tcaggctatgcactggctgacccgg

SEQ ID NO: 205791 - DNA, 25 bp, E. coli
gcaaaagcggtcgtcgacagaacat

SEQ ID NO: 205792 - DNA, 25 bp, E. coli
gcagcaggacaaaaacagtcaggct

SEQ ID NO: 205793 - DNA, 25 bp, E. coli
gcagcaggacaataacagtcaggct

SEQ ID NO: 205794 - DNA, 25 bp, E. coli
gcaaaagcggtcctcgacagaacat

SEQ ID NO: 205795 - DNA, 25 bp, E. coli
cggttcgccagcaagagtctacgct

SEQ ID NO: 205796 - DNA, 25 bp, E. coli
ctggcgattcgtgccgttcatcaag

SEQ ID NO: 205797 - DNA, 25 bp, E. coli
ctggcgattcgtcccgttcatcaag

SEQ ID NO: 205798 - DNA, 25 bp, E. coli
cggttcgccagctagagtctacgct

SEQ ID NO: 205799 - DNA, 25 bp, E. coli
tggtccggcgctgttttacttctgg

SEQ ID NO: 205800 - DNA, 25 bp, E. coli
tggtccggcgctcttttacttctgg

SEQ ID NO: 205801 - DNA, 25 bp, E. coli
ggctacatcattccgcagcaggaca

SEQ ID NO: 205802 - DNA, 25 bp, E. coli
ggctacatcattgcgcagcaggaca

SEQ ID NO: 205803 - DNA, 25 bp, E. coli
catggcgtgatgattatgaagcaga

SEQ ID NO: 205804 - DNA, 25 bp, E. coli
catggcgtgatgtttatgaagcaga

SEQ ID NO: 205805 - DNA, 25 bp, E. coli
catgaactgttaatggactatgcag

SEQ ID NO: 205806 - DNA, 25 bp, E. coli
catgaactgttattggactatgcag

SEQ ID NO: 205807 - DNA, 25 bp, E. coli
tacaacgtcagttttgaagaatggc

SEQ ID NO: 205808 - DNA, 25 bp, E. coli
tacaacgtcagtattgaagaatggc

SEQ ID NO: 205809 - DNA, 25 bp, E. coli
aactccggtcgatgcatattgtgat

SEQ ID NO: 205810 - DNA, 25 bp, E. coli
aactccggtcgaagcatattgtgat

SEQ ID NO: 205811 - DNA, 25 bp, E. coli
tatgaagcagaaaaaactccggtcg

SEQ ID NO: 205812 - DNA, 25 bp, E. coli
tatgaagcagaataaactccggtcg

SEQ ID NO: 205813 - DNA, 25 bp, E. coli
ttggttcaactatatacaacgtcag

SEQ ID NO: 205814 - DNA, 25 bp, E. coli
ttggttcaactaaatacaacgtcag

SEQ ID NO: 205815 - DNA, 25 bp, E. coli
gaagaatggcatcaactgttaatgg

SEQ ID NO: 205816 - DNA, 25 bp, E. coli
gaagaatggcatgaactgttaatgg

SEQ ID NO: 205817 - DNA, 25 bp, E. coli
gactatgcagagttacgtggtggca

SEQ ID NO: 205818 - DNA, 25 bp, E. coli
gactatgcagagatacgtggtggca

SEQ ID NO: 205819 - DNA, 25 bp, E. coli
cggtcgaagcatattgtgatgagtg

SEQ ID NO: 205820 - DNA, 25 bp, E. coli
cggtcgaagcattttgtgatgagtg

SEQ ID NO: 205821 - DNA, 25 bp, E. coli
tggcagtgctgcagatgctgaagca

SEQ ID NO: 205822 - DNA, 25 bp, E. coli
tggcagtgctgctgatgctgaagca

SEQ ID NO: 205823 - DNA, 25 bp, E. coli
gatgctgaagcaaggcgtgatgatt

SEQ ID NO: 205824 - DNA, 25 bp, E. coli
gatgctgaagcatggcgtgatgatt

SEQ ID NO: 205825 - DNA, 25 bp, E. coli
aatttaaatggtcggagtgcgcctc

SEQ ID NO: 205826 - DNA, 25 bp, E. coli
aatttaaatggtgggagtgcgcctc

SEQ ID NO: 205827 - DNA, 25 bp, E. coli
caccagacaccggatcaacaaagtt

SEQ ID NO: 205828 - DNA, 25 bp, E. coli
caccagacaccgcatcaacaaagtt

SEQ ID NO: 205829 - DNA, 25 bp, E. coli
taaataacgacattgctgtgtgtag

SEQ ID NO: 205830 - DNA, 25 bp, E. coli
taaaagtcatgtaagtccttattgg

SEQ ID NO: 205831 - DNA, 25 bp, E. coli
taaataacgacaatgctgtgtgtag

SEQ ID NO: 205832 - DNA, 25 bp, E. coli
agtgcgcctccggttgtaaataacg

SEQ ID NO: 205833 - DNA, 25 bp, E. coli
agtgcgcctccgcttgtaaataacg

SEQ ID NO: 205834 - DNA, 25 bp, E. coli
actggttgcagtgacctggaggcac

SEQ ID NO: 205835 - DNA, 25 bp, E. coli
actggttgcagtcacctggaggcac

SEQ ID NO: 205836 - DNA, 25 bp, E. coli
tttgggtgggaaagccgactgtaat

SEQ ID NO: 205837 - DNA, 25 bp, E. coli
tttgggtgggaatgccgactgtaat

SEQ ID NO: 205838 - DNA, 25 bp, E. coli
ttgaagttcggcagatgtccgccct

SEQ ID NO: 205839 - DNA, 25 bp, E. coli
ttgaagttcggctgatgtccgccct

SEQ ID NO: 205840 - DNA, 25 bp, E. coli
tccgatatccataaagagtcggtct

SEQ ID NO: 205841 - DNA, 25 bp, E. coli
tccgatatccattaagagtcggtct

SEQ ID NO: 205842 - DNA, 25 bp, E. coli
gagtcggtcttgtctgttaaattta

SEQ ID NO: 205843 - DNA, 25 bp, E. coli
gagtcggtcttgactgttaaattta

SEQ ID NO: 205844 - DNA, 25 bp, E. coli
cgcacgtggcacagttaaaagtcat

SEQ ID NO: 205845 - DNA, 25 bp, E. coli
cgcacgtggcactgttaaaagtcat

SEQ ID NO: 205846 - DNA, 25 bp, E. coli
taaaagtcatgttagtccttattgg

SEQ ID NO: 205847 - DNA, 25 bp, E. coli
caaaagcttgttgctcgcgcgaagt

SEQ ID NO: 205848 - DNA, 25 bp, E. coli
caaacggatgcccaaacacaggcat

SEQ ID NO: 205849 - DNA, 25 bp, E. coli
caaaagcttgttcctcgcgcgaagt

SEQ ID NO: 205850 - DNA, 25 bp, E. coli
caaacggatgccgaaacacaggcat

SEQ ID NO: 205851 - DNA, 25 bp, E. coli
tacctggtggcggtacaaacggatg

SEQ ID NO: 205852 - DNA, 25 bp, E. coli
tactcatagctgtatgggccattgg

SEQ ID NO: 205853 - DNA, 25 bp, E. coli
tacctggtggcgctacaaacggatg

SEQ ID NO: 205854 - DNA, 25 bp, E. coli
tactcatagctgaatgggccattgg

SEQ ID NO: 205855 - DNA, 25 bp, E. coli
tgaaacgcttaagggttacctggtg

SEQ ID NO: 205856 - DNA, 25 bp, E. coli
tgaaacgcttaacggttacctggtg

SEQ ID NO: 205857 - DNA, 25 bp, E. coli
tccactaaagagatagccaaactgg

SEQ ID NO: 205858 - DNA, 25 bp, E. coli
tccactaaagagttagccaaactgg

SEQ ID NO: 205859 - DNA, 25 bp, E. coli
gccaaactggctcgacaaaagcttg

SEQ ID NO: 205860 - DNA, 25 bp, E. coli
cctgatgagcgacagtgcaatggct

SEQ ID NO: 205861 - DNA, 25 bp, E. coli
gccaaactggctggacaaaagcttg

SEQ ID NO: 205862 - DNA, 25 bp, E. coli
cctgatgagcgagagtgcaatggct

SEQ ID NO: 205863 - DNA, 25 bp, E. coli
gcaatggctttaaccctgaacgaag

SEQ ID NO: 205864 - DNA, 25 bp, E. coli
gcaatggctttatccctgaacgaag

SEQ ID NO: 205865 - DNA, 25 bp, E. coli
taaccctgaacgtagccagaagtca

SEQ ID NO: 205866 - DNA, 25 bp, E. coli
taaccctgaacgaagccagaagtca

SEQ ID NO: 205867 - DNA, 25 bp, E. coli
gagttaatggtatatggttgcgcaa

SEQ ID NO: 205868 - DNA, 25 bp, E. coli
gagttaatggtaaatggttgcgcaa

SEQ ID NO: 205869 - DNA, 25 bp, E. coli
caacgcggcgagctttgatcaacga

SEQ ID NO: 205870 - DNA, 25 bp, E. coli
caaaatcgcgcccaaggatgtcgct

SEQ ID NO: 205871 - DNA, 25 bp, E. coli
caaaatcgcgccgaaggatgtcgct

SEQ ID NO: 205872 - DNA, 25 bp, E. coli
caacgcggcgaggtttgatcaacga

SEQ ID NO: 205873 - DNA, 25 bp, E. coli
catcatgagggaagcggtgatcgcc

SEQ ID NO: 205874 - DNA, 25 bp, E. coli
catcatgagggatgcggtgatcgcc

SEQ ID NO: 205875 - DNA, 25 bp, E. coli
gaaaccttaacgctatggaactcgc

SEQ ID NO: 205876 - DNA, 25 bp, E. coli
gaaaccttaacggtatggaactcgc

SEQ ID NO: 205877 - DNA, 25 bp, E. coli
tatggagcagcatcgatgttacgca

SEQ ID NO: 205878 - DNA, 25 bp, E. coli
tatggagcagcaacgatgttacgca

SEQ ID NO: 205879 - DNA, 25 bp, E. coli
tccgcgctgtagtagtcaccattgt

SEQ ID NO: 205880 - DNA, 25 bp, E. coli
tccgcgctgtagaagtcaccattgt

SEQ ID NO: 205881 - DNA, 25 bp, E. coli
tcttgcaggtatgttcgagccagcc

SEQ ID NO: 205882 - DNA, 25 bp, E. coli
tcttgcaggtatcttcgagccagcc

SEQ ID NO: 205883 - DNA, 25 bp, E. coli
ccagcggcggagcaactctttgatc

SEQ ID NO: 205884 - DNA, 25 bp, E. coli
ccagcggcggaggaactctttgatc

SEQ ID NO: 205885 - DNA, 25 bp, E. coli
gaacaggatctaattgaggcgctaa

SEQ ID NO: 205886 - DNA, 25 bp, E. coli
gaaacttcggcttcccctggagaga

SEQ ID NO: 205887 - DNA, 25 bp, E. coli
gaacaggatctatttgaggcgctaa

SEQ ID NO: 205888 - DNA, 25 bp, E. coli
gaaacttcggctacccctggagaga

SEQ ID NO: 205889 - DNA, 25 bp, E. coli
taaggcttgatgaaacaacgcggcg

SEQ ID NO: 205890 - DNA, 25 bp, E. coli
taaggcttgatgtaacaacgcggcg

SEQ ID NO: 205891 - DNA, 25 bp, E. coli
cacttcgccgaggatgaactgactg

SEQ ID NO: 205892 - DNA, 25 bp, E. coli
cacttcgccgagcatgaactgactg

SEQ ID NO: 205893 - DNA, 25 bp, E. coli
catcttaatggataacgtcaatcac

SEQ ID NO: 205894 - DNA, 25 bp, E. coli
catcttaatggaaaacgtcaatcac

SEQ ID NO: 205895 - DNA, 25 bp, E. coli
tagggaaccgcttgagctttataga

SEQ ID NO: 205896 - DNA, 25 bp, E. coli
tagggaaccgctagagctttataga

SEQ ID NO: 205897 - DNA, 25 bp, E. coli
tatattctgagatcggagctgcatg

SEQ ID NO: 205898 - DNA, 25 bp, E. coli
tatattctgagaacggagctgcatg

SEQ ID NO: 205899 - DNA, 25 bp, E. coli
tgagcctggcaataagacgcctggt

SEQ ID NO: 205900 - DNA, 25 bp, E. coli
tgagcctggcaaaaagacgcctggt

SEQ ID NO: 205901 - DNA, 25 bp, E. coli
gctacgcatcgttaacacttcgccg

SEQ ID NO: 205902 - DNA, 25 bp, E. coli
gctacgcatcgtaaacacttcgccg

SEQ ID NO: 205903 - DNA, 25 bp, E. coli
gaatttacttctatgactgtccacc

SEQ ID NO: 205904 - DNA, 25 bp, E. coli
gaatttacttctttgactgtccacc

SEQ ID NO: 205905 - DNA, 25 bp, E. coli
gaactgactgcgcaatgcataatga

SEQ ID NO: 205906 - DNA, 25 bp, E. coli
gaactgactgcggaatgcataatga

SEQ ID NO: 205907 - DNA, 25 bp, E. coli
cgggttttttcaagcagcgtgttca

SEQ ID NO: 205908 - DNA, 25 bp, E. coli
cgggttttttcatgcagcgtgttca

SEQ ID NO: 205909 - DNA, 25 bp, E. coli
tcaatcacaagaacgtagggaaccg

SEQ ID NO: 205910 - DNA, 25 bp, E. coli
tcaatcacaagatcgtagggaaccg

SEQ ID NO: 205911 - DNA, 25 bp, E. coli
gacgcctggtcgcaagaatttcaaa

SEQ ID NO: 205912 - DNA, 25 bp, E. coli
gacgcctggtcggaagaatttcaaa

SEQ ID NO: 205913 - DNA, 25 bp, E. coli
tactgcggaagcgattagcctgacg

SEQ ID NO: 205914 - DNA, 25 bp, E. coli
tacaatcgtccgtcgcaagaaggtt

SEQ ID NO: 205915 - DNA, 25 bp, E. coli
tactgcggaagccattagcctgacg

SEQ ID NO: 205916 - DNA, 25 bp, E. coli
tacaatcgtccgacgcaagaaggtt

SEQ ID NO: 205917 - DNA, 25 bp, E. coli
aaattctgtatattgtgccgtcccg

SEQ ID NO: 205918 - DNA, 25 bp, E. coli
aaattctgtataatgtgccgtcccg

SEQ ID NO: 205919 - DNA, 25 bp, E. coli
aaaaggtaatgtgtgtcgggctagc

SEQ ID NO: 205920 - DNA, 25 bp, E. coli
aaaaggtaatgtctgtcgggctagc

SEQ ID NO: 205921 - DNA, 25 bp, E. coli
tatcggaatcaaagaggcaacaggg

SEQ ID NO: 205922 - DNA, 25 bp, E. coli
tatcggaatcaatgaggcaacaggg

SEQ ID NO: 205923 - DNA, 25 bp, E. coli
ttctgttggcaccactggcgagtcc

SEQ ID NO: 205924 - DNA, 25 bp, E. coli
ttctgttggcacgactggcgagtcc

SEQ ID NO: 205925 - DNA, 25 bp, E. coli
gccgaggcacgcgttattaatcagc

SEQ ID NO: 205926 - DNA, 25 bp, E. coli
gccgaggcacgccttattaatcagc

SEQ ID NO: 205927 - DNA, 25 bp, E. coli
cgagcgcgctggacttcatgcaatt

SEQ ID NO: 205928 - DNA, 25 bp, E. coli
cgcgtgtaaaccagatcaaagagct

SEQ ID NO: 205929 - DNA, 25 bp, E. coli
cgcgtgtaaacctgatcaaagagct

SEQ ID NO: 205930 - DNA, 25 bp, E. coli
cgagcgcgctggtcttcatgcaatt

SEQ ID NO: 205931 - DNA, 25 bp, E. coli
ggcgagtccgcttccttaaatcatg

SEQ ID NO: 205932 - DNA, 25 bp, E. coli
ggcgagtccgctaccttaaatcatg

SEQ ID NO: 205933 - DNA, 25 bp, E. coli
taaggaactgggacttgtggcgacc

SEQ ID NO: 205934 - DNA, 25 bp, E. coli
taaggaactgggtcttgtggcgacc

SEQ ID NO: 205935 - DNA, 25 bp, E. coli
cataaatccctgttcgacggtacgt

SEQ ID NO: 205936 - DNA, 25 bp, E. coli
cataaatccctgatcgacggtacgt

SEQ ID NO: 205937 - DNA, 25 bp, E. coli
gaacccagtttctcggtcgggccat

SEQ ID NO: 205938 - DNA, 25 bp, E. coli
gaacccagtttcacggtcgggccat

SEQ ID NO: 205939 - DNA, 25 bp, E. coli
tatcgatacccgtaagctgacgcgt

SEQ ID NO: 205940 - DNA, 25 bp, E. coli
tattggttctggaagacggaaccca

SEQ ID NO: 205941 - DNA, 25 bp, E. coli
tatcgatacccgaaagctgacgcgt

SEQ ID NO: 205942 - DNA, 25 bp, E. coli
tattggttctggtagacggaaccca

SEQ ID NO: 205943 - DNA, 25 bp, E. coli
tgaaatttggtcaccacggcggcaa

SEQ ID NO: 205944 - DNA, 25 bp, E. coli
tgaaatttggtctccacggcggcaa

SEQ ID NO: 205945 - DNA, 25 bp, E. coli
cctatagctggacacaagggagctg

SEQ ID NO: 205946 - DNA, 25 bp, E. coli
cctatagctggagacaagggagctg

SEQ ID NO: 205947 - DNA, 25 bp, E. coli
gctgaaaatgaatccagacggcatc

SEQ ID NO: 205948 - DNA, 25 bp, E. coli
gctgaaaatgaaaccagacggcatc

SEQ ID NO: 205949 - DNA, 25 bp, E. coli
gcaacattacctgcaaacctgcgtg

SEQ ID NO: 205950 - DNA, 25 bp, E. coli
gcaacattacctccaaacctgcgtg

SEQ ID NO: 205951 - DNA, 25 bp, E. coli
gacggtacgttagagggcattcatc

SEQ ID NO: 205952 - DNA, 25 bp, E. coli
gacggtacgttacagggcattcatc

SEQ ID NO: 205953 - DNA, 25 bp, E. coli
cgagcggtgcgatgactgtcaaaat

SEQ ID NO: 205954 - DNA, 25 bp, E. coli
cgagcggtgcgaagactgtcaaaat

SEQ ID NO: 205955 - DNA, 25 bp, E. coli
taattgagcagtaccgtaaaaccgc

SEQ ID NO: 205956 - DNA, 25 bp, E. coli
taattgagcagttccgtaaaaccgc

SEQ ID NO: 205957 - DNA, 25 bp, E. coli
ttgcgcgaacgacgcatcaactttc

SEQ ID NO: 205958 - DNA, 25 bp, E. coli
ttgcgcgaacgaggcatcaactttc

SEQ ID NO: 205959 - DNA, 25 bp, E. coli
tttgtataagagctttcctgcaggg

SEQ ID NO: 205960 - DNA, 25 bp, E. coli
tttgtataagaggtttcctgcaggg

SEQ ID NO: 205961 - DNA, 25 bp, E. coli
tgtcaactttgtataagaggtttcc

SEQ ID NO: 205962 - DNA, 25 bp, E. coli
tgataccagcactccaatgggacgc

SEQ ID NO: 205963 - DNA, 25 bp, E. coli
tgataccagcacaccaatgggacgc

SEQ ID NO: 205964 - DNA, 25 bp, E. coli
tgtcaactttgtttaagaggtttcc

SEQ ID NO: 205965 - DNA, 25 bp, E. coli
tctgacggattcaattgataccagc

SEQ ID NO: 205966 - DNA, 25 bp, E. coli
tctgacggattctattgataccagc

SEQ ID NO: 205967 - DNA, 25 bp, E. coli
gcatcaactttcctagtctgacgga

SEQ ID NO: 205968 - DNA, 25 bp, E. coli
gcatcaactttcgtagtctgacgga

SEQ ID NO: 205969 - DNA, 25 bp, E. coli
gcacaccaatgggacgctttttctt

SEQ ID NO: 205970 - DNA, 25 bp, E. coli
gcacaccaatggcacgctttttctt

SEQ ID NO: 205971 - DNA, 25 bp, E. coli
gaacaatgggcacaagctggacgat

SEQ ID NO: 205972 - DNA, 25 bp, E. coli
gaacaatgggcagaagctggacgat

SEQ ID NO: 205973 - DNA, 25 bp, E. coli
cgtagtatgcggcatcttgtcgtgc

SEQ ID NO: 205974 - DNA, 25 bp, E. coli
ctatgatgttggagtgtcaactttg

SEQ ID NO: 205975 - DNA, 25 bp, E. coli
ctatgatgttggtgtgtcaactttg

SEQ ID NO: 205976 - DNA, 25 bp, E. coli
cgtagtatgcgggatcttgtcgtgc

SEQ ID NO: 205977 - DNA, 25 bp, E. coli
ggcacaagctggacgattaattgca

SEQ ID NO: 205978 - DNA, 25 bp, E. coli
ggcacaagctggtcgattaattgca

SEQ ID NO: 205979 - DNA, 25 bp, E. coli
atcgcaaacaggtggcggagatccc

SEQ ID NO: 205980 - DNA, 25 bp, E. coli
atcgcaaacaggaggcggagatccc

SEQ ID NO: 205981 - DNA, 25 bp, E. coli
attgatgttggtccccacgccgaga

SEQ ID NO: 205982 - DNA, 25 bp, E. coli
attgatgttggtgcccacgccgaga

SEQ ID NO: 205983 - DNA, 25 bp, E. coli
gttggctactgagccgaccgcaatt

SEQ ID NO: 205984 - DNA, 25 bp, E. coli
gttggctactgacccgaccgcaatt

SEQ ID NO: 205985 - DNA, 25 bp, E. coli
tgttggtgcccaggccgagatcatc

SEQ ID NO: 205986 - DNA, 25 bp, E. coli
tgttggtgcccacgccgagatcatc

SEQ ID NO: 205987 - DNA, 25 bp, E. coli
tgacccgaccgcaatttctgatcct

SEQ ID NO: 205988 - DNA, 25 bp, E. coli
tgacccgaccgctatttctgatcct

SEQ ID NO: 205989 - DNA, 25 bp, E. coli
gctactgacccgtccgcaatttctg

SEQ ID NO: 205990 - DNA, 25 bp, E. coli
gctactgacccgaccgcaatttctg

SEQ ID NO: 205991 - DNA, 25 bp, E. coli
cggagatcccgctggcagagctttc

SEQ ID NO: 205992 - DNA, 25 bp, E. coli
cggagatcccgcaggcagagctttc

SEQ ID NO: 205993 - DNA, 25 bp, E. coli
tggcagagctttccgttccggcgat

SEQ ID NO: 205994 - DNA, 25 bp, E. coli
tggcgctgctggtgatctcctccga

SEQ ID NO: 205995 - DNA, 25 bp, E. coli
tggcgctgctggagatctcctccga

SEQ ID NO: 205996 - DNA, 25 bp, E. coli
tggcagagctttgcgttccggcgat

SEQ ID NO: 205997 - DNA, 25 bp, E. coli
gagctttccgttgcggcgatcatga

SEQ ID NO: 205998 - DNA, 25 bp, E. coli
gatcccgctggctgagctttccgtt

SEQ ID NO: 205999 - DNA, 25 bp, E. coli
gagctttccgttccggcgatcatga

SEQ ID NO: 206000 - DNA, 25 bp, E. coli
gatcccgctggcagagctttccgtt

SEQ ID NO: 206001 - DNA, 25 bp, E. coli
ttccggcaccgtgcagaacttcaaa

SEQ ID NO: 206002 - DNA, 25 bp, E. coli
ttccggcaccgtccagaacttcaaa

SEQ ID NO: 206003 - DNA, 25 bp, E. coli
tatccctgcgcgctacttaagtatt

SEQ ID NO: 206004 - DNA, 25 bp, E. coli
tatccctgcgcggtacttaagtatt

SEQ ID NO: 206005 - DNA, 25 bp, E. coli
ttaagggaccatgcctcttatccct

SEQ ID NO: 206006 - DNA, 25 bp, E. coli
tatttttgattcaattccggcaccg

SEQ ID NO: 206007 - DNA, 25 bp, E. coli
tatttttgattctattccggcaccg

SEQ ID NO: 206008 - DNA, 25 bp, E. coli
ttaagggaccatccctcttatccct

SEQ ID NO: 206009 - DNA, 25 bp, E. coli
tcagaggtggcgtgggatttctccc

SEQ ID NO: 206010 - DNA, 25 bp, E. coli
tcagaggtggcgagggatttctccc

SEQ ID NO: 206011 - DNA, 25 bp, E. coli
cctgcgcgctacataagtatttttg

SEQ ID NO: 206012 - DNA, 25 bp, E. coli
cctgcgcgctacttaagtatttttg

SEQ ID NO: 206013 - DNA, 25 bp, E. coli
gaatccttccggataattagctctc

SEQ ID NO: 206014 - DNA, 25 bp, E. coli
gaatccttccggttaattagctctc

SEQ ID NO: 206015 - DNA, 25 bp, E. coli
cgttgaggatgcgtgccacatcaga

SEQ ID NO: 206016 - DNA, 25 bp, E. coli
cgttgaggatgcctgccacatcaga

SEQ ID NO: 206017 - DNA, 25 bp, E. coli
cgtccagaacttcaaacgcgttgaa

SEQ ID NO: 206018 - DNA, 25 bp, E. coli
cgtccagaacttgaaacgcgttgaa

SEQ ID NO: 206019 - DNA, 25 bp, E. coli
gataattagctctcccctttaaggg

SEQ ID NO: 206020 - DNA, 25 bp, E. coli
gataattagctcacccctttaaggg

SEQ ID NO: 206021 - DNA, 25 bp, E. coli
gatgcctgccacatcagaggtggcg

SEQ ID NO: 206022 - DNA, 25 bp, E. coli
gatgcctgccacttcagaggtggcg

SEQ ID NO: 206023 - DNA, 25 bp, E. coli
cactgggtgttctacgtcatcggcg

SEQ ID NO: 206024 - DNA, 25 bp, E. coli
cactgggtgttcaacgtcatcggcg

SEQ ID NO: 206025 - DNA, 25 bp, E. coli
cattacgaaaccattgtggagccgc

SEQ ID NO: 206026 - DNA, 25 bp, E. coli
cattacgaaacctttgtggagccgc

SEQ ID NO: 206027 - DNA, 25 bp, E. coli
tacggaaaccgatcaggcatacatc

SEQ ID NO: 206028 - DNA, 25 bp, E. coli
tacggaaaccgaacaggcatacatc

SEQ ID NO: 206029 - DNA, 25 bp, E. coli
aggaaatgatcggaccgctgaccga

SEQ ID NO: 206030 - DNA, 25 bp, E. coli
aggaaatgatcgcaccgctgaccga

SEQ ID NO: 206031 - DNA, 25 bp, E. coli
tatgcgctttatttctcctgcgagg

SEQ ID NO: 206032 - DNA, 25 bp, E. coli
tatgcgctttatatctcctgcgagg

SEQ ID NO: 206033 - DNA, 25 bp, E. coli
gcgtactgcgcaccatgctgattaa

SEQ ID NO: 206034 - DNA, 25 bp, E. coli
gcgtactgcgcagcatgctgattaa

SEQ ID NO: 206035 - DNA, 25 bp, E. coli
gactgtatcagattgtggcccggct

SEQ ID NO: 206036 - DNA, 25 bp, E. coli
gactgtatcagaatgtggcccggct

SEQ ID NO: 206037 - DNA, 25 bp, E. coli
cgtgcttaacgggttcagaacagaa

SEQ ID NO: 206038 - DNA, 25 bp, E. coli
cgtgcttaacggcttcagaacagaa

SEQ ID NO: 206039 - DNA, 25 bp, E. coli
gtgtctgttgactcgcatcccggcg

SEQ ID NO: 206040 - DNA, 25 bp, E. coli
ggacgacttcctgcgtcattacgaa

SEQ ID NO: 206041 - DNA, 25 bp, E. coli
gtgtctgttgacacgcatcccggcg

SEQ ID NO: 206042 - DNA, 25 bp, E. coli
ggtacgccgccgattgaggcacata

SEQ ID NO: 206043 - DNA, 25 bp, E. coli
ggtacgccgccgtttgaggcacata

SEQ ID NO: 206044 - DNA, 25 bp, E. coli
ggacgacttcctccgtcattacgaa

SEQ ID NO: 206045 - DNA, 25 bp, E. coli
caagcgcatcgccttgctggagcaa

SEQ ID NO: 206046 - DNA, 25 bp, E. coli
caagcgcatcgcgttgctggagcaa

SEQ ID NO: 206047 - DNA, 25 bp, E. coli
cagcagctttggatttggacgacag

SEQ ID NO: 206048 - DNA, 25 bp, E. coli
cagcagctttggttttggacgacag

SEQ ID NO: 206049 - DNA, 25 bp, E. coli
catggcgcgccgaaacatttaaccg

SEQ ID NO: 206050 - DNA, 25 bp, E. coli
catggcgcgccgtaacatttaaccg

SEQ ID NO: 206051 - DNA, 25 bp, E. coli
tgctggagcaaaggctaaacgtggt

SEQ ID NO: 206052 - DNA, 25 bp, E. coli
tgctggagcaaacgctaaacgtggt

SEQ ID NO: 206053 - DNA, 25 bp, E. coli
gaatttattgcggaacatggcgcgc

SEQ ID NO: 206054 - DNA, 25 bp, E. coli
gaatttattgcgcaacatggcgcgc

SEQ ID NO: 206055 - DNA, 25 bp, E. coli
cgtgcctggtcaataaagagcgcga

SEQ ID NO: 206056 - DNA, 25 bp, E. coli
cgtgcctggtcattaaagagcgcga

SEQ ID NO: 206057 - DNA, 25 bp, E. coli
cgtctttatgctggtggctcgccgg

SEQ ID NO: 206058 - DNA, 25 bp, E. coli
cgtctttatgctcgtggctcgccgg

SEQ ID NO: 206059 - DNA, 25 bp, E. coli
gattgctctgcgatcctggtgggat

SEQ ID NO: 206060 - DNA, 25 bp, E. coli
gattgctctgcgttcctggtgggat

SEQ ID NO: 206061 - DNA, 25 bp, E. coli
ggcgaaggcgtatccgcaactggaa

SEQ ID NO: 206062 - DNA, 25 bp, E. coli
ggcgaaggcgtaaccgcaactggaa

SEQ ID NO: 206063 - DNA, 25 bp, E. coli
tcaccattaccgaagaaggagagcg

SEQ ID NO: 206064 - DNA, 25 bp, E. coli
taaccgatctttgtgcattgccgtg

SEQ ID NO: 206065 - DNA, 25 bp, E. coli
taaccgatctttctgcattgccgtg

SEQ ID NO: 206066 - DNA, 25 bp, E. coli
tcaccattaccgtagaaggagagcg

SEQ ID NO: 206067 - DNA, 25 bp, E. coli
tagccagatcttaagccaggttcag

SEQ ID NO: 206068 - DNA, 25 bp, E. coli
tagccagatctttagccaggttcag

SEQ ID NO: 206069 - DNA, 25 bp, E. coli
tatttggtcgcactattcagcaagg

SEQ ID NO: 206070 - DNA, 25 bp, E. coli
tatttggtcgcagtattcagcaagg

SEQ ID NO: 206071 - DNA, 25 bp, E. coli
tgcttatatgcacggcacggcgcag

SEQ ID NO: 206072 - DNA, 25 bp, E. coli
tgcttatatgcagggcacggcgcag

SEQ ID NO: 206073 - DNA, 25 bp, E. coli
tcgtgaccagggaaaacaagcgccg

SEQ ID NO: 206074 - DNA, 25 bp, E. coli
tcgtgaccagggtaaacaagcgccg

SEQ ID NO: 206075 - DNA, 25 bp, E. coli
gccgactggcagaaacgttatccga

SEQ ID NO: 206076 - DNA, 25 bp, E. coli
gccgactggcagtaacgttatccga

SEQ ID NO: 206077 - DNA, 25 bp, E. coli
gaaaatattctgcaaggctggctgg

SEQ ID NO: 206078 - DNA, 25 bp, E. coli
gaaaatattctggaaggctggctgg

SEQ ID NO: 206079 - DNA, 25 bp, E. coli
cgaatacgctggtgatcaacgccga

SEQ ID NO: 206080 - DNA, 25 bp, E. coli
cgaatacgctggagatcaacgccga

SEQ ID NO: 206081 - DNA, 25 bp, E. coli
cgttaattgctcaggaaccgctgct

SEQ ID NO: 206082 - DNA, 25 bp, E. coli
cgttaattgctctggaaccgctgct

SEQ ID NO: 206083 - DNA, 25 bp, E. coli
gatcgccatgcgtaacggtagccag

SEQ ID NO: 206084 - DNA, 25 bp, E. coli
gatcgccatgcgaaacggtagccag

SEQ ID NO: 206085 - DNA, 25 bp, E. coli
tggcaacgccgggtgaaatcgcttt

SEQ ID NO: 206086 - DNA, 25 bp, E. coli
tggcaacgccggctgaaatcgcttt

SEQ ID NO: 206087 - DNA, 25 bp, E. coli
tcacaaatgcgccaggttcagggtt

SEQ ID NO: 206088 - DNA, 25 bp, E. coli
tcacaaatgcgcgaggttcagggtt

SEQ ID NO: 206089 - DNA, 25 bp, E. coli
gcaaaacttatttaccccgaatgat

SEQ ID NO: 206090 - DNA, 25 bp, E. coli
caccgcggagaggatgaaaaatatc

SEQ ID NO: 206091 - DNA, 25 bp, E. coli
gcaaaacttattaaccccgaatgat

SEQ ID NO: 206092 - DNA, 25 bp, E. coli
caccgcggagagcatgaaaaatatc

SEQ ID NO: 206093 - DNA, 25 bp, E. coli
aaaaaacgctctctctgaccattct

SEQ ID NO: 206094 - DNA, 25 bp, E. coli
aaaaaacgctctgtctgaccattct

SEQ ID NO: 206095 - DNA, 25 bp, E. coli
tattaaccccgattgatgattctca

SEQ ID NO: 206096 - DNA, 25 bp, E. coli
tattaaccccgaatgatgattctca

SEQ ID NO: 206097 - DNA, 25 bp, E. coli
tcctgcatcacagcgcggagagcat

SEQ ID NO: 206098 - DNA, 25 bp, E. coli
tctctgaccattctttgtgcatccc

SEQ ID NO: 206099 - DNA, 25 bp, E. coli
tcctgcatcacaccgcggagagcat

SEQ ID NO: 206100 - DNA, 25 bp, E. coli
tctctgaccattgtttgtgcatccc

SEQ ID NO: 206101 - DNA, 25 bp, E. coli
tctgtactctcccatcaactgcgaa

SEQ ID NO: 206102 - DNA, 25 bp, E. coli
tctgtactctccgatcaactgcgaa

SEQ ID NO: 206103 - DNA, 25 bp, E. coli
gaacgctctgggcacgcaaaactta

SEQ ID NO: 206104 - DNA, 25 bp, E. coli
gaaaaatatcgtcactctgtactct

SEQ ID NO: 206105 - DNA, 25 bp, E. coli
gaaaaatatcgtgactctgtactct

SEQ ID NO: 206106 - DNA, 25 bp, E. coli
gaacgctctggggacgcaaaactta

SEQ ID NO: 206107 - DNA, 25 bp, E. coli
ggatgacttgggacaaaaaaacgct

SEQ ID NO: 206108 - DNA, 25 bp, E. coli
ggatgacttgggtcaaaaaaacgct

SEQ ID NO: 206109 - DNA, 25 bp, E. coli
gatgattctcatttaggagatattc

SEQ ID NO: 206110 - DNA, 25 bp, E. coli
gatgattctcatataggagatattc

SEQ ID NO: 206111 - DNA, 25 bp, E. coli
caaacatattcagaagcgtgaggga

SEQ ID NO: 206112 - DNA, 25 bp, E. coli
cacgcacacccatacatattcagaa

SEQ ID NO: 206113 - DNA, 25 bp, E. coli
caaacatattcacaagcgtgaggga

SEQ ID NO: 206114 - DNA, 25 bp, E. coli
cacgcacacccaaacatattcagaa

SEQ ID NO: 206115 - DNA, 25 bp, E. coli
tacgagtactacaggaaaacccacg

SEQ ID NO: 206116 - DNA, 25 bp, E. coli
tacgagtactactggaaaacccacg

SEQ ID NO: 206117 - DNA, 25 bp, E. coli
accttttgcgttttatcgccagggc

SEQ ID NO: 206118 - DNA, 25 bp, E. coli
accttttgcgttatatcgccagggc

SEQ ID NO: 206119 - DNA, 25 bp, E. coli
tatcgccagggcaacgagtactact

SEQ ID NO: 206120 - DNA, 25 bp, E. coli
tatcgccagggctacgagtactact

SEQ ID NO: 206121 - DNA, 25 bp, E. coli
tgccaacctgactgatgaacagatc

SEQ ID NO: 206122 - DNA, 25 bp, E. coli
tgccaacctgacagatgaacagatc

SEQ ID NO: 206123 - DNA, 25 bp, E. coli
gccatcaaagcggtggctgctgtaa

SEQ ID NO: 206124 - DNA, 25 bp, E. coli
gccatcaaagcgctggctgctgtaa

SEQ ID NO: 206125 - DNA, 25 bp, E. coli
gtactactggaaaacccacgcacac

SEQ ID NO: 206126 - DNA, 25 bp, E. coli
gatatagtgccatcaaagcgctggc

SEQ ID NO: 206127 - DNA, 25 bp, E. coli
gatatagtgccaacaaagcgctggc

SEQ ID NO: 206128 - DNA, 25 bp, E. coli
gtgatgccaaccagactgatgaaca

SEQ ID NO: 206129 - DNA, 25 bp, E. coli
gtgatgccaacctgactgatgaaca

SEQ ID NO: 206130 - DNA, 25 bp, E. coli
gtactactggaatacccacgcacac

SEQ ID NO: 206131 - DNA, 25 bp, E. coli
tcagaagcgtgagggatatagtgcc

SEQ ID NO: 206132 - DNA, 25 bp, E. coli
tcagaagcgtgacggatatagtgcc

SEQ ID NO: 206133 - DNA, 25 bp, E. coli
cagcgctggcgcagggacataaact

SEQ ID NO: 206134 - DNA, 25 bp, E. coli
cagcgctggcgctgggacataaact

SEQ ID NO: 206135 - DNA, 25 bp, E. coli
taaaacgctgtttgtgcagcaacag

SEQ ID NO: 206136 - DNA, 25 bp, E. coli
taaaacgctgttagtgcagcaacag

SEQ ID NO: 206137 - DNA, 25 bp, E. coli
cgtcatcgcggttcggcgtttggtc

SEQ ID NO: 206138 - DNA, 25 bp, E. coli
cgtcatcgcggtacggcgtttggtc

SEQ ID NO: 206139 - DNA, 25 bp, E. coli
tgtgcaaagctgcttgcatgcagcg

SEQ ID NO: 206140 - DNA, 25 bp, E. coli
tgtgcaaagctggttgcatgcagcg

SEQ ID NO: 206141 - DNA, 25 bp, E. coli
tgcaagagagacacacggaacagga

SEQ ID NO: 206142 - DNA, 25 bp, E. coli
tgcaagagagactcacggaacagga

SEQ ID NO: 206143 - DNA, 25 bp, E. coli
tgccctgctgatagctgatacgccc

SEQ ID NO: 206144 - DNA, 25 bp, E. coli
tgccctgctgattgctgatacgccc

SEQ ID NO: 206145 - DNA, 25 bp, E. coli
cgccgctatcaatctgccgttaatg

SEQ ID NO: 206146 - DNA, 25 bp, E. coli
cgccgctatcaaactgccgttaatg

SEQ ID NO: 206147 - DNA, 25 bp, E. coli
gatacgcccattattgatgttcgcg

SEQ ID NO: 206148 - DNA, 25 bp, E. coli
gatacgcccatttttgatgttcgcg

SEQ ID NO: 206149 - DNA, 25 bp, E. coli
ggtcagcgctcagatattgtgcaaa

SEQ ID NO: 206150 - DNA, 25 bp, E. coli
ggtcagcgctcacatattgtgcaaa

SEQ ID NO: 206151 - DNA, 25 bp, E. coli
ggaacaggactatcgtgccctgctg

SEQ ID NO: 206152 - DNA, 25 bp, E. coli
tgttcgcgcccctatcgagtttgag

SEQ ID NO: 206153 - DNA, 25 bp, E. coli
tgttcgcgccccaatcgagtttgag

SEQ ID NO: 206154 - DNA, 25 bp, E. coli
ggaacaggactaacgtgccctgctg

SEQ ID NO: 206155 - DNA, 25 bp, E. coli
aacagggcttacattgcggcaggca

SEQ ID NO: 206156 - DNA, 25 bp, E. coli
acagcacgttgtgcgcttgagcagg

SEQ ID NO: 206157 - DNA, 25 bp, E. coli
acagcacgttgtccgcttgagcagg

SEQ ID NO: 206158 - DNA, 25 bp, E. coli
aacagggcttactttgcggcaggca

SEQ ID NO: 206159 - DNA, 25 bp, E. coli
ttctggcgacgagagattaccccgg

SEQ ID NO: 206160 - DNA, 25 bp, E. coli
ttctggcgacgacagattaccccgg

SEQ ID NO: 206161 - DNA, 25 bp, E. coli
tgtttgttgaaggagaactgcacgc

SEQ ID NO: 206162 - DNA, 25 bp, E. coli
tgtttgttgaagcagaactgcacgc

SEQ ID NO: 206163 - DNA, 25 bp, E. coli
tgacaattacgactggactggcgcg

SEQ ID NO: 206164 - DNA, 25 bp, E. coli
tgacaattacgagtggactggcgcg

SEQ ID NO: 206165 - DNA, 25 bp, E. coli
gaaatcgcattatcagtggtctaag

SEQ ID NO: 206166 - DNA, 25 bp, E. coli
gaaatcgcattaacagtggtctaag

SEQ ID NO: 206167 - DNA, 25 bp, E. coli
cgattattttgccaaactctggcga

SEQ ID NO: 206168 - DNA, 25 bp, E. coli
cgcattcatggtatggcgagcgatg

SEQ ID NO: 206169 - DNA, 25 bp, E. coli
cgcattcatggtttggcgagcgatg

SEQ ID NO: 206170 - DNA, 25 bp, E. coli
cgattattttgcgaaactctggcga

SEQ ID NO: 206171 - DNA, 25 bp, E. coli
ctcactttgttgcttggagcaaccc

SEQ ID NO: 206172 - DNA, 25 bp, E. coli
cattcatttcaggttgccgtagtgg

SEQ ID NO: 206173 - DNA, 25 bp, E. coli
cattcatttcagcttgccgtagtgg

SEQ ID NO: 206174 - DNA, 25 bp, E. coli
ctcactttgttggttggagcaaccc

SEQ ID NO: 206175 - DNA, 25 bp, E. coli
gatgcggttgtaatgcagcaaacag

SEQ ID NO: 206176 - DNA, 25 bp, E. coli
gatgcggttgtattgcagcaaacag

SEQ ID NO: 206177 - DNA, 25 bp, E. coli
caatgcaggatattaagatgaaaaa

SEQ ID NO: 206178 - DNA, 25 bp, E. coli
cacataggattctgccgtttttaac

SEQ ID NO: 206179 - DNA, 25 bp, E. coli
cacataggattcagccgtttttaac

SEQ ID NO: 206180 - DNA, 25 bp, E. coli
caatgcaggataataagatgaaaaa

SEQ ID NO: 206181 - DNA, 25 bp, E. coli
aaatgttgttttctgccgctctggc

SEQ ID NO: 206182 - DNA, 25 bp, E. coli
aaatgttgttttgtgccgctctggc

SEQ ID NO: 206183 - DNA, 25 bp, E. coli
ttgttgtcacattggattctgccgt

SEQ ID NO: 206184 - DNA, 25 bp, E. coli
tttactgttggatacaaacctacag

SEQ ID NO: 206185 - DNA, 25 bp, E. coli
tttactgttggaaacaaacctacag

SEQ ID NO: 206186 - DNA, 25 bp, E. coli
ttgttgtcacataggattctgccgt

SEQ ID NO: 206187 - DNA, 25 bp, E. coli
tgttttctgccggtctggcaatgct

SEQ ID NO: 206188 - DNA, 25 bp, E. coli
tgttggaaacaatcctacagcagta

SEQ ID NO: 206189 - DNA, 25 bp, E. coli
tgttttctgccgctctggcaatgct

SEQ ID NO: 206190 - DNA, 25 bp, E. coli
tgttggaaacaaacctacagcagta

SEQ ID NO: 206191 - DNA, 25 bp, E. coli
gccgtttttaacaatgcaggataat

SEQ ID NO: 206192 - DNA, 25 bp, E. coli
gccgtttttaactatgcaggataat

SEQ ID NO: 206193 - DNA, 25 bp, E. coli
cgatgcagcaaaaatttgtggtggt

SEQ ID NO: 206194 - DNA, 25 bp, E. coli
cgctctggcaatgcttattacagga

SEQ ID NO: 206195 - DNA, 25 bp, E. coli
cgatgcagcaaatatttgtggtggt

SEQ ID NO: 206196 - DNA, 25 bp, E. coli
cgctctggcaatccttattacagga

SEQ ID NO: 206197 - DNA, 25 bp, E. coli
tggaaacaaacctacagcagtaaca

SEQ ID NO: 206198 - DNA, 25 bp, E. coli
tggaaacaaaccaacagcagtaaca

SEQ ID NO: 206199 - DNA, 25 bp, E. coli
cacaaattgaaaatagcctcgcagg

SEQ ID NO: 206200 - DNA, 25 bp, E. coli
cacaaattgaaattagcctcgcagg

SEQ ID NO: 206201 - DNA, 25 bp, E. coli
catgaatccggtgatctttgcgggc

SEQ ID NO: 206202 - DNA, 25 bp, E. coli
catgaatccggtcatctttgcgggc

SEQ ID NO: 206203 - DNA, 25 bp, E. coli
taaacagttccggtgttgccctggc

SEQ ID NO: 206204 - DNA, 25 bp, E. coli
tacaaaatcgcaatggctgcaggat

SEQ ID NO: 206205 - DNA, 25 bp, E. coli
taaacagttccgctgttgccctggc

SEQ ID NO: 206206 - DNA, 25 bp, E. coli
tacaaaatcgcattggctgcaggat

SEQ ID NO: 206207 - DNA, 25 bp, E. coli
taaaccagggcataatacaaaatcg

SEQ ID NO: 206208 - DNA, 25 bp, E. coli
taaaccagggcaaaatacaaaatcg

SEQ ID NO: 206209 - DNA, 25 bp, E. coli
tctttgtgactggtcgtagcccgac

SEQ ID NO: 206210 - DNA, 25 bp, E. coli
tctttgtgactgctcgtagcccgac

SEQ ID NO: 206211 - DNA, 25 bp, E. coli
tctttgcgggcgttaaaccagggca

SEQ ID NO: 206212 - DNA, 25 bp, E. coli
tctttgcgggcgataaaccagggca

SEQ ID NO: 206213 - DNA, 25 bp, E. coli
ccagctgattgaaatgcatgtacgc

SEQ ID NO: 206214 - DNA, 25 bp, E. coli
ccagctgattgatatgcatgtacgc

SEQ ID NO: 206215 - DNA, 25 bp, E. coli
gcattccaaaagaggtcgctcgcca

SEQ ID NO: 206216 - DNA, 25 bp, E. coli
gcattccaaaagtggtcgctcgcca

SEQ ID NO: 206217 - DNA, 25 bp, E. coli
cccttgccacaagcgggtgcgtttg

SEQ ID NO: 206218 - DNA, 25 bp, E. coli
cccttgccacaaccgggtgcgtttg

SEQ ID NO: 206219 - DNA, 25 bp, E. coli
cgatgtcggcgcacgtggtatccgc

SEQ ID NO: 206220 - DNA, 25 bp, E. coli
cgatgtcggcgctcgtggtatccgc

SEQ ID NO: 206221 - DNA, 25 bp, E. coli
catgctgtgcttagccgtaccgggt

SEQ ID NO: 206222 - DNA, 25 bp, E. coli
catgctgtgctttgccgtaccgggt

SEQ ID NO: 206223 - DNA, 25 bp, E. coli
tatctcaccggaacggcggcaattg

SEQ ID NO: 206224 - DNA, 25 bp, E. coli
tatctcaccggatcggcggcaattg

SEQ ID NO: 206225 - DNA, 25 bp, E. coli
tcttaaccgcgtagaagacggcgaa

SEQ ID NO: 206226 - DNA, 25 bp, E. coli
tcttaaccgcgttgaagacggcgaa

SEQ ID NO: 206227 - DNA, 25 bp, E. coli
tctcgatggtgaagcgtaacgttcc

SEQ ID NO: 206228 - DNA, 25 bp, E. coli
tcattatttcgaagccggctgggca

SEQ ID NO: 206229 - DNA, 25 bp, E. coli
tcattatttcgatgccggctgggca

SEQ ID NO: 206230 - DNA, 25 bp, E. coli
tctcgatggtgatgcgtaacgttcc

SEQ ID NO: 206231 - DNA, 25 bp, E. coli
gatctacagctttgtgcgggccatc

SEQ ID NO: 206232 - DNA, 25 bp, E. coli
gattatggcctgctggaatccacga

SEQ ID NO: 206233 - DNA, 25 bp, E. coli
gattatggcctggtggaatccacga

SEQ ID NO: 206234 - DNA, 25 bp, E. coli
gttttaccgggaactggctggcaca

SEQ ID NO: 206235 - DNA, 25 bp, E. coli
gatctacagcttagtgcgggccatc

SEQ ID NO: 206236 - DNA, 25 bp, E. coli
gttttaccgggatctggctggcaca

SEQ ID NO: 206237 - DNA, 25 bp, E. coli
gggctgaccaactccaactggctgt

SEQ ID NO: 206238 - DNA, 25 bp, E. coli
gggctgaccaacaccaactggctgt

SEQ ID NO: 206239 - DNA, 25 bp, E. coli
tggactacaccctgacgctggataa

SEQ ID NO: 206240 - DNA, 25 bp, E. coli
tggactacacccagacgctggataa

SEQ ID NO: 206241 - DNA, 25 bp, E. coli
taacttcgacgtactggcgacgcaa

SEQ ID NO: 206242 - DNA, 25 bp, E. coli
taacttcgacgttctggcgacgcaa

SEQ ID NO: 206243 - DNA, 25 bp, E. coli
taaagcctatgatattcgcgggaaa

SEQ ID NO: 206244 - DNA, 25 bp, E. coli
taaagcctatgaaattcgcgggaaa

SEQ ID NO: 206245 - DNA, 25 bp, E. coli
accgttgatgtggtgactgccgcag

SEQ ID NO: 206246 - DNA, 25 bp, E. coli
aacacggcgcggatatgggcattgc

SEQ ID NO: 206247 - DNA, 25 bp, E. coli
aacacggcgcggttatgggcattgc

SEQ ID NO: 206248 - DNA, 25 bp, E. coli
accgttgatgtgctgactgccgcag

SEQ ID NO: 206249 - DNA, 25 bp, E. coli
tgaccgctgtttgctgtttgacgaa

SEQ ID NO: 206250 - DNA, 25 bp, E. coli
tgaccgctgtttcctgtttgacgaa

SEQ ID NO: 206251 - DNA, 25 bp, E. coli
tcagcatgacctttgccgactggcg

SEQ ID NO: 206252 - DNA, 25 bp, E. coli
tcagcatgacctatgccgactggcg

SEQ ID NO: 206253 - DNA, 25 bp, E. coli
gcttactgcgacagcggcatgatcc

SEQ ID NO: 206254 - DNA, 25 bp, E. coli
gcttactgcgactgcggcatgatcc

SEQ ID NO: 206255 - DNA, 25 bp, E. coli
gcaaactggcgctacccgttgaggc

SEQ ID NO: 206256 - DNA, 25 bp, E. coli
gcaaactggcgcaacccgttgaggc

SEQ ID NO: 206257 - DNA, 25 bp, E. coli
cggcatgatcccctggctgctggtc

SEQ ID NO: 206258 - DNA, 25 bp, E. coli
cggcatgatcccgtggctgctggtc

SEQ ID NO: 206259 - DNA, 25 bp, E. coli
gtaatgtcgaaaaccggacacgcct

SEQ ID NO: 206260 - DNA, 25 bp, E. coli
ggtgagatcaacagcaaactggcgc

SEQ ID NO: 206261 - DNA, 25 bp, E. coli
gtaatgtcgaaatccggacacgcct

SEQ ID NO: 206262 - DNA, 25 bp, E. coli
ggtgagatcaactgcaaactggcgc

SEQ ID NO: 206263 - DNA, 25 bp, E. coli
gacgcttacgttcatcacctgttcg

SEQ ID NO: 206264 - DNA, 25 bp, E. coli
gacgcttacgttgatcacctgttcg

SEQ ID NO: 206265 - DNA, 25 bp, E. coli
aattctcggcgagcacgttacgctg

SEQ ID NO: 206266 - DNA, 25 bp, E. coli
aattctcggcgaccacgttacgctg

SEQ ID NO: 206267 - DNA, 25 bp, E. coli
caaagcgaacgaaattgtcattgcg

SEQ ID NO: 206268 - DNA, 25 bp, E. coli
caaagcgaacgatattgtcattgcg

SEQ ID NO: 206269 - DNA, 25 bp, E. coli
cacagaagaactgcatccgcgtact

SEQ ID NO: 206270 - DNA, 25 bp, E. coli
cacagaagaactccatccgcgtact

SEQ ID NO: 206271 - DNA, 25 bp, E. coli
catggtctgccattcgaactgaaag

SEQ ID NO: 206272 - DNA, 25 bp, E. coli
catggtctgccaatcgaactgaaag

SEQ ID NO: 206273 - DNA, 25 bp, E. coli
tgattatgcgctggtgcaaatcgac

SEQ ID NO: 206274 - DNA, 25 bp, E. coli
tgattatgcgctcgtgcaaatcgac

SEQ ID NO: 206275 - DNA, 25 bp, E. coli
tgctgacgcccaccagagcgaagtc

SEQ ID NO: 206276 - DNA, 25 bp, E. coli
tgctgacgcccagcagagcgaagtc

SEQ ID NO: 206277 - DNA, 25 bp, E. coli
gccgagctggaactgttgcgcttta

SEQ ID NO: 206278 - DNA, 25 bp, E. coli
gccgagctggaagtgttgcgcttta

SEQ ID NO: 206279 - DNA, 25 bp, E. coli
gcgttagcgattacaccattcttgg

SEQ ID NO: 206280 - DNA, 25 bp, E. coli
gcgttagcgatttcaccattcttgg

SEQ ID NO: 206281 - DNA, 25 bp, E. coli
gacttcgatgttgcggcaattctcg

SEQ ID NO: 206282 - DNA, 25 bp, E. coli
gacttcgatgttccggcaattctcg

SEQ ID NO: 206283 - DNA, 25 bp, E. coli
tcaaaaatatggtctggaaaccgct

SEQ ID NO: 206284 - DNA, 25 bp, E. coli
tcaaaaatatggactggaaaccgct

SEQ ID NO: 206285 - DNA, 25 bp, E. coli
ggtacttacccgactctggatggcg

SEQ ID NO: 206286 - DNA, 25 bp, E. coli
ggtacttacccgtctctggatggcg

SEQ ID NO: 206287 - DNA, 25 bp, E. coli
cagagaatgttgatcggtcgcagca

SEQ ID NO: 206288 - DNA, 25 bp, E. coli
cagagaatgttgttcggtcgcagca

SEQ ID NO: 206289 - DNA, 25 bp, E. coli
tacagaggtatcctgcaggccgatg

SEQ ID NO: 206290 - DNA, 25 bp, E. coli
tacagaggtatcgtgcaggccgatg

SEQ ID NO: 206291 - DNA, 25 bp, E. coli
tatgttcgtgaccatcgcaacgccg

SEQ ID NO: 206292 - DNA, 25 bp, E. coli
tagaaaagaagatcgcacgggcaga

SEQ ID NO: 206293 - DNA, 25 bp, E. coli
tagaaaagaagaacgcacgggcaga

SEQ ID NO: 206294 - DNA, 25 bp, E. coli
tatgttcgtgacgatcgcaacgccg

SEQ ID NO: 206295 - DNA, 25 bp, E. coli
tgaaaccgctgggagaaagcatctc

SEQ ID NO: 206296 - DNA, 25 bp, E. coli
tgaaataaccgggtatgcccgcgag

SEQ ID NO: 206297 - DNA, 25 bp, E. coli
tgacatcatgggtgagcagcttcgc

SEQ ID NO: 206298 - DNA, 25 bp, E. coli
tgaaaccgctggcagaaagcatctc

SEQ ID NO: 206299 - DNA, 25 bp, E. coli
tgacatcatgggagagcagcttcgc

SEQ ID NO: 206300 - DNA, 25 bp, E. coli
tgaaataaccggctatgcccgcgag

SEQ ID NO: 206301 - DNA, 25 bp, E. coli
gaaacgcgtataaccgagctccaga

SEQ ID NO: 206302 - DNA, 25 bp, E. coli
gaaacgcgtatatccgagctccaga

SEQ ID NO: 206303 - DNA, 25 bp, E. coli
gatatcatcaacaccgcgttcaggg

SEQ ID NO: 206304 - DNA, 25 bp, E. coli
gttgcaactcacgtcaatggccgga

SEQ ID NO: 206305 - DNA, 25 bp, E. coli
gttgcaactcacctcaatggccgga

SEQ ID NO: 206306 - DNA, 25 bp, E. coli
gatatcatcaactccgcgttcaggg

SEQ ID NO: 206307 - DNA, 25 bp, E. coli
ggaactgtacgcaatcgaggctgag

SEQ ID NO: 206308 - DNA, 25 bp, E. coli
ggaactgtacgctatcgaggctgag

SEQ ID NO: 206309 - DNA, 25 bp, E. coli
cactatgaactgaaaggctggccgg

SEQ ID NO: 206310 - DNA, 25 bp, E. coli
cactatgaactgtaaggctggccgg

SEQ ID NO: 206311 - DNA, 25 bp, E. coli
aggtcggctcctttaaactgcgcgg

SEQ ID NO: 206312 - DNA, 25 bp, E. coli
aggtcggctcctataaactgcgcgg

SEQ ID NO: 206313 - DNA, 25 bp, E. coli
tggtttaacaccaatccggcgcagg

SEQ ID NO: 206314 - DNA, 25 bp, E. coli
tgcgtaacgacgctcctgaatcaca

SEQ ID NO: 206315 - DNA, 25 bp, E. coli
tgcgtaacgacggtcctgaatcaca

SEQ ID NO: 206316 - DNA, 25 bp, E. coli
tcatctcattgtggatgggcccgcg

SEQ ID NO: 206317 - DNA, 25 bp, E. coli
tcatctcattgtcgatgggcccgcg

SEQ ID NO: 206318 - DNA, 25 bp, E. coli
gcaacgcagctgctggtcccattct

SEQ ID NO: 206319 - DNA, 25 bp, E. coli
gaatcacacttcagcaagcgcggta

SEQ ID NO: 206320 - DNA, 25 bp, E. coli
gaatcacacttctgcaagcgcggta

SEQ ID NO: 206321 - DNA, 25 bp, E. coli
gcaacgcagctggtggtcccattct

SEQ ID NO: 206322 - DNA, 25 bp, E. coli
cattgtgggtacaggcaacgcggta

SEQ ID NO: 206323 - DNA, 25 bp, E. coli
cattgtgggtactggcaacgcggta

SEQ ID NO: 206324 - DNA, 25 bp, E. coli
cattctttaaagatgtgatgccgca

SEQ ID NO: 206325 - DNA, 25 bp, E. coli
cattctttaaagttgtgatgccgca

SEQ ID NO: 206326 - DNA, 25 bp, E. coli
gtttggctggccgaacatttggtca

SEQ ID NO: 206327 - DNA, 25 bp, E. coli
gtttggctggcccaacatttggtca

SEQ ID NO: 206328 - DNA, 25 bp, E. coli
gtattttccgcaaggcaccgattca

SEQ ID NO: 206329 - DNA, 25 bp, E. coli
gtattttccgcatggcaccgattca

SEQ ID NO: 206330 - DNA, 25 bp, E. coli
tggtttaacacctatccggcgcagg

SEQ ID NO: 206331 - DNA, 25 bp, E. coli
aagcctcgctgagctgtgacagggt

SEQ ID NO: 206332 - DNA, 25 bp, E. coli
cagcatacggtacgcaacaggcgag

SEQ ID NO: 206333 - DNA, 25 bp, E. coli
caacaggcgagttgtgcttttcagt

SEQ ID NO: 206334 - DNA, 25 bp, E. coli
caacaggcgagtagtgcttttcagt

SEQ ID NO: 206335 - DNA, 25 bp, E. coli
cagcatacggtaggcaacaggcgag

SEQ ID NO: 206336 - DNA, 25 bp, E. coli
agtgcttttcagattgcgcaggcgc

SEQ ID NO: 206337 - DNA, 25 bp, E. coli
agtgcttttcagtttgcgcaggcgc

SEQ ID NO: 206338 - DNA, 25 bp, E. coli
aagcctcgctgacctgtgacagggt

SEQ ID NO: 206339 - DNA, 25 bp, E. coli
tatcgggaaggggtctataacgcta

SEQ ID NO: 206340 - DNA, 25 bp, E. coli
tatcgggaagggctctataacgcta

SEQ ID NO: 206341 - DNA, 25 bp, E. coli
ttttgccatcgtggtgaccgggcca

SEQ ID NO: 206342 - DNA, 25 bp, E. coli
ttttgccatcgtcgtgaccgggcca

SEQ ID NO: 206343 - DNA, 25 bp, E. coli
gactggggctgggttcgtcaaacct

SEQ ID NO: 206344 - DNA, 25 bp, E. coli
gactggggctggcttcgtcaaacct

SEQ ID NO: 206345 - DNA, 25 bp, E. coli
cggtacgcaacacgcgagtagtgct

SEQ ID NO: 206346 - DNA, 25 bp, E. coli
ctggcggaagccacgctgacctgtg

SEQ ID NO: 206347 - DNA, 25 bp, E. coli
ctggcggaagcctcgctgacctgtg

SEQ ID NO: 206348 - DNA, 25 bp, E. coli
ctgtgacagggtggtacagttctga

SEQ ID NO: 206349 - DNA, 25 bp, E. coli
cggtacgcaacaggcgagtagtgct

SEQ ID NO: 206350 - DNA, 25 bp, E. coli
ctgtgacagggtcgtacagttctga

SEQ ID NO: 206351 - DNA, 25 bp, E. coli
gtgaccgggccagcatacggtacgc

SEQ ID NO: 206352 - DNA, 25 bp, E. coli
gtgaccgggccaccatacggtacgc

SEQ ID NO: 206353 - DNA, 25 bp, E. coli
accgctgatttcacgccgcttctga

SEQ ID NO: 206354 - DNA, 25 bp, E. coli
accgctgatttctcgccgcttctga

SEQ ID NO: 206355 - DNA, 25 bp, E. coli
aacagccatttgcagtatactcccg

SEQ ID NO: 206356 - DNA, 25 bp, E. coli
aacagccatttggagtatactcccg

SEQ ID NO: 206357 - DNA, 25 bp, E. coli
tagtgaaaacgggaatacgccacgc

SEQ ID NO: 206358 - DNA, 25 bp, E. coli
tagtgaaaacggcaatacgccacgc

SEQ ID NO: 206359 - DNA, 25 bp, E. coli
tcttcgtctttctgtaaaagcgtta

SEQ ID NO: 206360 - DNA, 25 bp, E. coli
tcttcgtctttcagtaaaagcgtta

SEQ ID NO: 206361 - DNA, 25 bp, E. coli
gccgcttctgatgcaatagtgaaaa

SEQ ID NO: 206362 - DNA, 25 bp, E. coli
gccgcttctgatccaatagtgaaaa

SEQ ID NO: 206363 - DNA, 25 bp, E. coli
cgttgctgacgataacagccatttg

SEQ ID NO: 206364 - DNA, 25 bp, E. coli
cgcttcatcaatctaaggtattccg

SEQ ID NO: 206365 - DNA, 25 bp, E. coli
cgcttcatcaatgtaaggtattccg

SEQ ID NO: 206366 - DNA, 25 bp, E. coli
cgttgctgacgaaaacagccatttg

SEQ ID NO: 206367 - DNA, 25 bp, E. coli
ctgtgccaaccatccgctgatttca

SEQ ID NO: 206368 - DNA, 25 bp, E. coli
ctgtgccaaccaaccgctgatttca

SEQ ID NO: 206369 - DNA, 25 bp, E. coli
gggcaatttttgctcgcttcatcaa

SEQ ID NO: 206370 - DNA, 25 bp, E. coli
gggcaatttttggtcgcttcatcaa

SEQ ID NO: 206371 - DNA, 25 bp, E. coli
taatttaccctgatgccctgtgcca

SEQ ID NO: 206372 - DNA, 25 bp, E. coli
taatttctttaagtggtgcgggcaa

SEQ ID NO: 206373 - DNA, 25 bp, E. coli
taatttaccctgttgccctgtgcca

SEQ ID NO: 206374 - DNA, 25 bp, E. coli
taatttctttaactggtgcgggcaa

SEQ ID NO: 206375 - DNA, 25 bp, E. coli
caccgtcgcgctcgataaagagaaa

SEQ ID NO: 206376 - DNA, 25 bp, E. coli
caccgtcgcgctggataaagagaaa

SEQ ID NO: 206377 - DNA, 25 bp, E. coli
tacggattccagagtgcacaaaagc

SEQ ID NO: 206378 - DNA, 25 bp, E. coli
tacattaacgatggtcatctgccgg

SEQ ID NO: 206379 - DNA, 25 bp, E. coli
tacggattccagtgtgcacaaaagc

SEQ ID NO: 206380 - DNA, 25 bp, E. coli
taaatatggctttcgccagagcgcg

SEQ ID NO: 206381 - DNA, 25 bp, E. coli
taaatatggcttacgccagagcgcg

SEQ ID NO: 206382 - DNA, 25 bp, E. coli
tacattaacgatcgtcatctgccgg

SEQ ID NO: 206383 - DNA, 25 bp, E. coli
tgttagcgggcacaaaatatcgcgg

SEQ ID NO: 206384 - DNA, 25 bp, E. coli
tgttagcgggcagaaaatatcgcgg

SEQ ID NO: 206385 - DNA, 25 bp, E. coli
gaactttatctcacatggcacgcgt

SEQ ID NO: 206386 - DNA, 25 bp, E. coli
gaactttatctctcatggcacgcgt

SEQ ID NO: 206387 - DNA, 25 bp, E. coli
gatttggttgcggtccgtcaggaac

SEQ ID NO: 206388 - DNA, 25 bp, E. coli
gatttggttgcgctccgtcaggaac

SEQ ID NO: 206389 - DNA, 25 bp, E. coli
ggcgcgtcgcttccagaaaattgat

SEQ ID NO: 206390 - DNA, 25 bp, E. coli
tggacgaaatcgagaaagcgcaccc

SEQ ID NO: 206391 - DNA, 25 bp, E. coli
tggacgaaatcgtgaaagcgcaccc

SEQ ID NO: 206392 - DNA, 25 bp, E. coli
ggcgcgtcgcttgcagaaaattgat

SEQ ID NO: 206393 - DNA, 25 bp, E. coli
tcagcgtgtactccaacgtgcggtc

SEQ ID NO: 206394 - DNA, 25 bp, E. coli
tcagcgtgtactgcaacgtgcggtc

SEQ ID NO: 206395 - DNA, 25 bp, E. coli
gatgttatcgaccaagcgggcgctc

SEQ ID NO: 206396 - DNA, 25 bp, E. coli
gatgttatcgacgaagcgggcgctc

SEQ ID NO: 206397 - DNA, 25 bp, E. coli
attgccgcaggtccgcctgcgcctg

SEQ ID NO: 206398 - DNA, 25 bp, E. coli
attgccgcaggtgcgcctgcgcctg

SEQ ID NO: 206399 - DNA, 25 bp, E. coli
ttttataaacgatttaatgcaggag

SEQ ID NO: 206400 - DNA, 25 bp, E. coli
ttgccgcaggtgcgcctgcgcctga

SEQ ID NO: 206401 - DNA, 25 bp, E. coli
tttataaacgaattaatgcaggaga

SEQ ID NO: 206402 - DNA, 25 bp, E. coli
ttgccgcaggtgggcctgcgcctga

SEQ ID NO: 206403 - DNA, 25 bp, E. coli
ttataaacgaattaatgcaggagat

SEQ ID NO: 206404 - DNA, 25 bp, E. coli
ttataaacgaataaatgcaggagat

SEQ ID NO: 206405 - DNA, 25 bp, E. coli
ttttataaacgaattaatgcaggag

SEQ ID NO: 206406 - DNA, 25 bp, E. coli
tttataaacgaaataatgcaggaga

SEQ ID NO: 206407 - DNA, 25 bp, E. coli
tgccgcaggtgcgcctgcgcctgaa

SEQ ID NO: 206408 - DNA, 25 bp, E. coli
tgccgcaggtgcccctgcgcctgaa

SEQ ID NO: 206409 - DNA, 25 bp, E. coli
ccgcaggtgcgcctgcgcctgaaat

SEQ ID NO: 206410 - DNA, 25 bp, E. coli
ccgcaggtgcgcgtgcgcctgaaat

SEQ ID NO: 206411 - DNA, 25 bp, E. coli
cgcaggtgcgccagcgcctgaaatc

SEQ ID NO: 206412 - DNA, 25 bp, E. coli
cgtattcgctcaaataactgttatg

SEQ ID NO: 206413 - DNA, 25 bp, E. coli
cgtattcgctcatataactgttatg

SEQ ID NO: 206414 - DNA, 25 bp, E. coli
cgcaggtgcgcctgcgcctgaaatc

SEQ ID NO: 206415 - DNA, 25 bp, E. coli
gattgccgcaggtgcgcctgcgcct

SEQ ID NO: 206416 - DNA, 25 bp, E. coli
gttttataaacgaattaatgcagga

SEQ ID NO: 206417 - DNA, 25 bp, E. coli
gttttataaacgtattaatgcagga

SEQ ID NO: 206418 - DNA, 25 bp, E. coli
gattgccgcaggagcgcctgcgcct

SEQ ID NO: 206419 - DNA, 25 bp, E. coli
aattggccgcgaaatctctttcaac

SEQ ID NO: 206420 - DNA, 25 bp, E. coli
aattggccgcgatatctctttcaac

SEQ ID NO: 206421 - DNA, 25 bp, E. coli
acgcttaacggcggtgggcctgatt

SEQ ID NO: 206422 - DNA, 25 bp, E. coli
acgcttaacggccgtgggcctgatt

SEQ ID NO: 206423 - DNA, 25 bp, E. coli
tttccatctcaagtgtgaaattggc

SEQ ID NO: 206424 - DNA, 25 bp, E. coli
tttccatctcaactgtgaaattggc

SEQ ID NO: 206425 - DNA, 25 bp, E. coli
tgatgaagatggtcgcttaacggcg

SEQ ID NO: 206426 - DNA, 25 bp, E. coli
tgatgaagatggacgcttaacggcg

SEQ ID NO: 206427 - DNA, 25 bp, E. coli
tcgcttgtgatgtagatggacgctt

SEQ ID NO: 206428 - DNA, 25 bp, E. coli
tgcgcctggtgtgattcaggcgtta

SEQ ID NO: 206429 - DNA, 25 bp, E. coli
tgcgcctggtgtcattcaggcgtta

SEQ ID NO: 206430 - DNA, 25 bp, E. coli
tcgcttgtgatgaagatggacgctt

SEQ ID NO: 206431 - DNA, 25 bp, E. coli
tctctttcaacgaattaacggcgga

SEQ ID NO: 206432 - DNA, 25 bp, E. coli
tctctttcaacgtattaacggcgga

SEQ ID NO: 206433 - DNA, 25 bp, E. coli
gaattaacggcggaatatgatgctg

SEQ ID NO: 206434 - DNA, 25 bp, E. coli
gaatcgatttccatctcaactgtga

SEQ ID NO: 206435 - DNA, 25 bp, E. coli
gaattaacggcgcaatatgatgctg

SEQ ID NO: 206436 - DNA, 25 bp, E. coli
gaatcgatttccttctcaactgtga

SEQ ID NO: 206437 - DNA, 25 bp, E. coli
cgcaatgggaatggatttccatctc

SEQ ID NO: 206438 - DNA, 25 bp, E. coli
cgcaatgggaatcgatttccatctc

SEQ ID NO: 206439 - DNA, 25 bp, E. coli
ggaatatgatgctgttttcctcggc

SEQ ID NO: 206440 - DNA, 25 bp, E. coli
ggaatatgatgcagttttcctcggc

SEQ ID NO: 206441 - DNA, 25 bp, E. coli
caatggttgatgacgttcaagaaca

SEQ ID NO: 206442 - DNA, 25 bp, E. coli
caatggttgatgtcgttcaagaaca

SEQ ID NO: 206443 - DNA, 25 bp, E. coli
tacagagtctacacttggcttagga

SEQ ID NO: 206444 - DNA, 25 bp, E. coli
taactgatcgacacattttgactag

SEQ ID NO: 206445 - DNA, 25 bp, E. coli
tacagagtctactcttggcttagga

SEQ ID NO: 206446 - DNA, 25 bp, E. coli
tagtgacatttgcatgcttcaaagc

SEQ ID NO: 206447 - DNA, 25 bp, E. coli
tagtcacttgacttaagcctccatc

SEQ ID NO: 206448 - DNA, 25 bp, E. coli
tagtgacatttggatgcttcaaagc

SEQ ID NO: 206449 - DNA, 25 bp, E. coli
tagtcacttgacataagcctccatc

SEQ ID NO: 206450 - DNA, 25 bp, E. coli
tcgcaaatcccttctcaacgataag

SEQ ID NO: 206451 - DNA, 25 bp, E. coli
tcgcaaatccctactcaacgataag

SEQ ID NO: 206452 - DNA, 25 bp, E. coli
gcttcaaagcctctcggaattggtt

SEQ ID NO: 206453 - DNA, 25 bp, E. coli
gcttcaaagcctgtcggaattggtt

SEQ ID NO: 206454 - DNA, 25 bp, E. coli
gaatcacttttaaattctcagaggg

SEQ ID NO: 206455 - DNA, 25 bp, E. coli
gaatcacttttatattctcagaggg

SEQ ID NO: 206456 - DNA, 25 bp, E. coli
gaacacgatattgacggtttaccca

SEQ ID NO: 206457 - DNA, 25 bp, E. coli
gaacacgatattcacggtttaccca

SEQ ID NO: 206458 - DNA, 25 bp, E. coli
cccaaagctcgttgcagattttgca

SEQ ID NO: 206459 - DNA, 25 bp, E. coli
cccaaagctcgtagcagattttgca

SEQ ID NO: 206460 - DNA, 25 bp, E. coli
ggtttaccgcttgtttagtcacttg

SEQ ID NO: 206461 - DNA, 25 bp, E. coli
ggtttaccgcttctttagtcacttg

SEQ ID NO: 206462 - DNA, 25 bp, E. coli
taactgatcgactcattttgactag

SEQ ID NO: 206463 - DNA, 25 bp, E. coli
aatctgcgccactattcttcccatg

SEQ ID NO: 206464 - DNA, 25 bp, E. coli
aatctgcgccacaattcttcccatg

SEQ ID NO: 206465 - DNA, 25 bp, E. coli
cactattcttcccatgctcaggaga

SEQ ID NO: 206466 - DNA, 25 bp, E. coli
cactattcttccgatgctcaggaga

SEQ ID NO: 206467 - DNA, 25 bp, E. coli
tacacggctgcagaattccgctaca

SEQ ID NO: 206468 - DNA, 25 bp, E. coli
tacacggctgcacaattccgctaca

SEQ ID NO: 206469 - DNA, 25 bp, E. coli
attcttcccatggtcaggagatatc

SEQ ID NO: 206470 - DNA, 25 bp, E. coli
attcttcccatgctcaggagatatc

SEQ ID NO: 206471 - DNA, 25 bp, E. coli
ttttttaagctactgagtacacggc

SEQ ID NO: 206472 - DNA, 25 bp, E. coli
ttttttaagctagtgagtacacggc

SEQ ID NO: 206473 - DNA, 25 bp, E. coli
tttcatccggacaagcgatatgcgc

SEQ ID NO: 206474 - DNA, 25 bp, E. coli
tttcatccggactagcgatatgcgc

SEQ ID NO: 206475 - DNA, 25 bp, E. coli
tgagtacacggcagcagaattccgc

SEQ ID NO: 206476 - DNA, 25 bp, E. coli
tgagtacacggctgcagaattccgc

SEQ ID NO: 206477 - DNA, 25 bp, E. coli
tccggactagcgttatgcgccgagt

SEQ ID NO: 206478 - DNA, 25 bp, E. coli
tccggactagcgatatgcgccgagt

SEQ ID NO: 206479 - DNA, 25 bp, E. coli
gaattccgctactatctgcgccact

SEQ ID NO: 206480 - DNA, 25 bp, E. coli
gaattccgctacaatctgcgccact

SEQ ID NO: 206481 - DNA, 25 bp, E. coli
gactagcgatatgcgccgagttttt

SEQ ID NO: 206482 - DNA, 25 bp, E. coli
gactagcgatatccgccgagttttt

SEQ ID NO: 206483 - DNA, 25 bp, E. coli
taagctagtgagtacacggctgcag

SEQ ID NO: 206484 - DNA, 25 bp, E. coli
taagctagtgagaacacggctgcag

SEQ ID NO: 206485 - DNA, 25 bp, E. coli
aagacaggaggagaggcaagaattc

SEQ ID NO: 206486 - DNA, 25 bp, E. coli
aagacaggaggacaggcaagaattc

SEQ ID NO: 206487 - DNA, 25 bp, E. coli
gacaaactaccggtggtagtgccga

SEQ ID NO: 206488 - DNA, 25 bp, E. coli
gacaaactaccgctggtagtgccga

SEQ ID NO: 206489 - DNA, 25 bp, E. coli
catgcatcggcaactggaggcggat

SEQ ID NO: 206490 - DNA, 25 bp, E. coli
catgcatcggcatctggaggcggat

SEQ ID NO: 206491 - DNA, 25 bp, E. coli
tagtgccgattcacttttatcaggg

SEQ ID NO: 206492 - DNA, 25 bp, E. coli
taccgctggtagagccgattctctt

SEQ ID NO: 206493 - DNA, 25 bp, E. coli
taccgctggtagtgccgattctctt

SEQ ID NO: 206494 - DNA, 25 bp, E. coli
tagtgccgattctcttttatcaggg

SEQ ID NO: 206495 - DNA, 25 bp, E. coli
gctggtagtgcccattctcttttat

SEQ ID NO: 206496 - DNA, 25 bp, E. coli
gctggtagtgccgattctcttttat

SEQ ID NO: 206497 - DNA, 25 bp, E. coli
gatcacgacaaagtaccgctggtag

SEQ ID NO: 206498 - DNA, 25 bp, E. coli
ggatcacgacaaactaccgctggta

SEQ ID NO: 206499 - DNA, 25 bp, E. coli
ggatcacgacaatctaccgctggta

SEQ ID NO: 206500 - DNA, 25 bp, E. coli
tggaggcggatcacgacaaactacc

SEQ ID NO: 206501 - DNA, 25 bp, E. coli
tggaggcggatctcgacaaactacc

SEQ ID NO: 206502 - DNA, 25 bp, E. coli
gaggcggatcacgacaaactaccgc

SEQ ID NO: 206503 - DNA, 25 bp, E. coli
gatcacgacaaactaccgctggtag

SEQ ID NO: 206504 - DNA, 25 bp, E. coli
gaggagaggcaacaattcgcccagc

SEQ ID NO: 206505 - DNA, 25 bp, E. coli
gaggagaggcaagaattcgcccagc

SEQ ID NO: 206506 - DNA, 25 bp, E. coli
gaggcggatcaccacaaactaccgc

SEQ ID NO: 206507 - DNA, 25 bp, E. coli
cagtctctacagcacgccgagtgaa

SEQ ID NO: 206508 - DNA, 25 bp, E. coli
cagtctctacaggacgccgagtgaa

SEQ ID NO: 206509 - DNA, 25 bp, E. coli
tacaccgattgaagagtgctacgag

SEQ ID NO: 206510 - DNA, 25 bp, E. coli
tacaccgattgatgagtgctacgag

SEQ ID NO: 206511 - DNA, 25 bp, E. coli
acgggttatggtatcagtctctaca

SEQ ID NO: 206512 - DNA, 25 bp, E. coli
acgggttatggtttcagtctctaca

SEQ ID NO: 206513 - DNA, 25 bp, E. coli
tgcaggcacatgtgcgtggcgatat

SEQ ID NO: 206514 - DNA, 25 bp, E. coli
tgagcgtggcgatattcactatcac

SEQ ID NO: 206515 - DNA, 25 bp, E. coli
tgcaggcacatgagcgtggcgatat

SEQ ID NO: 206516 - DNA, 25 bp, E. coli
tgagcgtggcgaaattcactatcac

SEQ ID NO: 206517 - DNA, 25 bp, E. coli
tcgccattgttgaacgtctgcgtca

SEQ ID NO: 206518 - DNA, 25 bp, E. coli
tcagacgccgttagtaacctttggt

SEQ ID NO: 206519 - DNA, 25 bp, E. coli
tcagacgccgtttgtaacctttggt

SEQ ID NO: 206520 - DNA, 25 bp, E. coli
tcgccattgttgtacgtctgcgtca

SEQ ID NO: 206521 - DNA, 25 bp, E. coli
gaaaggtatcgccattgttgaacgt

SEQ ID NO: 206522 - DNA, 25 bp, E. coli
gaaaggtatcgcgattgttgaacgt

SEQ ID NO: 206523 - DNA, 25 bp, E. coli
cgtgcgtctcaaagctgacgatgat

SEQ ID NO: 206524 - DNA, 25 bp, E. coli
cggtgagttcgagtgcaccagcaaa

SEQ ID NO: 206525 - DNA, 25 bp, E. coli
cggtgagttcgactgcaccagcaaa

SEQ ID NO: 206526 - DNA, 25 bp, E. coli
cgtgcgtctcaatgctgacgatgat

SEQ ID NO: 206527 - DNA, 25 bp, E. coli
ggctttaccggtgagttcgagtgca

SEQ ID NO: 206528 - DNA, 25 bp, E. coli
ggctttaccggtcagttcgagtgca

SEQ ID NO: 206529 - DNA, 25 bp, E. coli
aattaccgtctcgatgctctcggca

SEQ ID NO: 206530 - DNA, 25 bp, E. coli
aattaccgtctccatgctctcggca

SEQ ID NO: 206531 - DNA, 25 bp, E. coli
tacgctcggcaaaattaccgtctcg

SEQ ID NO: 206532 - DNA, 25 bp, E. coli
tagtgatgcagcgtgccttcgtgcg

SEQ ID NO: 206533 - DNA, 25 bp, E. coli
tagtgatgcagcctgccttcgtgcg

SEQ ID NO: 206534 - DNA, 25 bp, E. coli
tacgctcggcaatattaccgtctcg

SEQ ID NO: 206535 - DNA, 25 bp, E. coli
ttgtcgcggcgaggctggataaaca

SEQ ID NO: 206536 - DNA, 25 bp, E. coli
ttgtcgcggcgacgctggataaaca

SEQ ID NO: 206537 - DNA, 25 bp, E. coli
tgattgagaaccctccgtggctgac

SEQ ID NO: 206538 - DNA, 25 bp, E. coli
tgattgagaaccgtccgtggctgac

SEQ ID NO: 206539 - DNA, 25 bp, E. coli
tcccgctgtacgaggcgtttgtcgc

SEQ ID NO: 206540 - DNA, 25 bp, E. coli
tcccgctgtacgtggcgtttgtcgc

SEQ ID NO: 206541 - DNA, 25 bp, E. coli
ttcccgacggtgcaagtcatcgcca

SEQ ID NO: 206542 - DNA, 25 bp, E. coli
ttcccgacggtggaagtcatcgcca

SEQ ID NO: 206543 - DNA, 25 bp, E. coli
gccataccatgcagatcctcgggat

SEQ ID NO: 206544 - DNA, 25 bp, E. coli
gccataccatgctgatcctcgggat

SEQ ID NO: 206545 - DNA, 25 bp, E. coli
ccgttctggcggttgttgcttaaca

SEQ ID NO: 206546 - DNA, 25 bp, E. coli
ccgttctggcggatgttgcttaaca

SEQ ID NO: 206547 - DNA, 25 bp, E. coli
tggaaaacatcctcaacatctgggt

SEQ ID NO: 206548 - DNA, 25 bp, E. coli
tggaaaacatccacaacatctgggt

SEQ ID NO: 206549 - DNA, 25 bp, E. coli
gatggcgttcagcattacgctcggc

SEQ ID NO: 206550 - DNA, 25 bp, E. coli
gatggcgttcaggattacgctcggc

SEQ ID NO: 206551 - DNA, 25 bp, E. coli
aattttgtggcgggcaatccggaag

SEQ ID NO: 206552 - DNA, 25 bp, E. coli
aattttgtggcgcgcaatccggaag

SEQ ID NO: 206553 - DNA, 25 bp, E. coli
agagctgacggcgatgacagcctcg

SEQ ID NO: 206554 - DNA, 25 bp, E. coli
atgtcagagctgtcggccatgacag

SEQ ID NO: 206555 - DNA, 25 bp, E. coli
attttgtggcggccaatccggaagc

SEQ ID NO: 206556 - DNA, 25 bp, E. coli
atgtcagagctgacggccatgacag

SEQ ID NO: 206557 - DNA, 25 bp, E. coli
agagctgacggccatgacagcctcg

SEQ ID NO: 206558 - DNA, 25 bp, E. coli
attttgtggcgggcaatccggaagc

SEQ ID NO: 206559 - DNA, 25 bp, E. coli
tttgtggcgggcaatccggaagcgg

SEQ ID NO: 206560 - DNA, 25 bp, E. coli
tttgtggcgggctatccggaagcgg

SEQ ID NO: 206561 - DNA, 25 bp, E. coli
ttgtggcgggcattccggaagcgga

SEQ ID NO: 206562 - DNA, 25 bp, E. coli
ttgtggcgggcaatccggaagcgga

SEQ ID NO: 206563 - DNA, 25 bp, E. coli
tgtggcgggcaaaccggaagcggac

SEQ ID NO: 206564 - DNA, 25 bp, E. coli
tgtggcgggcaatccggaagcggac

SEQ ID NO: 206565 - DNA, 25 bp, E. coli
tgtcagagctgacggccatgacagc

SEQ ID NO: 206566 - DNA, 25 bp, E. coli
tgtcagagctgagggccatgacagc

SEQ ID NO: 206567 - DNA, 25 bp, E. coli
gtcagagctgacggccatgacagcc

SEQ ID NO: 206568 - DNA, 25 bp, E. coli
gtcagagctgaccgccatgacagcc

SEQ ID NO: 206569 - DNA, 25 bp, E. coli
gagctgacggccatgacagcctcgt

SEQ ID NO: 206570 - DNA, 25 bp, E. coli
gagctgacggccttgacagcctcgt

SEQ ID NO: 206571 - DNA, 25 bp, E. coli
gatgtcagagctgacggccatgaca

SEQ ID NO: 206572 - DNA, 25 bp, E. coli
gatgtcagagctcacggccatgaca

SEQ ID NO: 206573 - DNA, 25 bp, E. coli
aatggcacaagccagacggtgaaag

SEQ ID NO: 206574 - DNA, 25 bp, E. coli
aatggcacaagcgagacggtgaaag

SEQ ID NO: 206575 - DNA, 25 bp, E. coli
caccgcgcaatcacgtgaaaccgga

SEQ ID NO: 206576 - DNA, 25 bp, E. coli
caccgcgcaatctcgtgaaaccgga

SEQ ID NO: 206577 - DNA, 25 bp, E. coli
tgcgtagcaacaccccgcaagaaga

SEQ ID NO: 206578 - DNA, 25 bp, E. coli
tcgtgaaaccggaattgcctccgtt

SEQ ID NO: 206579 - DNA, 25 bp, E. coli
tcgtgaaaccggtattgcctccgtt

SEQ ID NO: 206580 - DNA, 25 bp, E. coli
tccggtttgtgcaaaaagcgggcaa

SEQ ID NO: 206581 - DNA, 25 bp, E. coli
tccggtttgtgctaaaagcgggcaa

SEQ ID NO: 206582 - DNA, 25 bp, E. coli
tgcgtagcaacagcccgcaagaaga

SEQ ID NO: 206583 - DNA, 25 bp, E. coli
tcatcaaattatcggctccagccag

SEQ ID NO: 206584 - DNA, 25 bp, E. coli
tcatcaaattatgggctccagccag

SEQ ID NO: 206585 - DNA, 25 bp, E. coli
cctctgcggaaaagggcatcgcgtc

SEQ ID NO: 206586 - DNA, 25 bp, E. coli
cctctgcggaaatgggcatcgcgtc

SEQ ID NO: 206587 - DNA, 25 bp, E. coli
gcccgcaagaagaacgctatgagaa

SEQ ID NO: 206588 - DNA, 25 bp, E. coli
gcccgcaagaagtacgctatgagaa

SEQ ID NO: 206589 - DNA, 25 bp, E. coli
gccagacggtgatagacaatacgta

SEQ ID NO: 206590 - DNA, 25 bp, E. coli
gccagacggtgaaagacaatacgta

SEQ ID NO: 206591 - DNA, 25 bp, E. coli
ggtttgaactcagtaagagcagtga

SEQ ID NO: 206592 - DNA, 25 bp, E. coli
ggtttgaactcactaagagcagtga

SEQ ID NO: 206593 - DNA, 25 bp, E. coli
ggcaaattctatttcaatctgaaag

SEQ ID NO: 206594 - DNA, 25 bp, E. coli
ggcaaattctatatcaatctgaaag

SEQ ID NO: 206595 - DNA, 25 bp, E. coli
tacgttttttcaagctgggacgcgc

SEQ ID NO: 206596 - DNA, 25 bp, E. coli
taaagaatctgatgcgctgacgaaa

SEQ ID NO: 206597 - DNA, 25 bp, E. coli
taaagaatctgaagcgctgacgaaa

SEQ ID NO: 206598 - DNA, 25 bp, E. coli
tacgttttttcatgctgggacgcgc

SEQ ID NO: 206599 - DNA, 25 bp, E. coli
tcgtgaattagcaacgcgtgccgcc

SEQ ID NO: 206600 - DNA, 25 bp, E. coli
tcgtgaattagctacgcgtgccgcc

SEQ ID NO: 206601 - DNA, 25 bp, E. coli
tgccgccaatggctgtaataagttg

SEQ ID NO: 206602 - DNA, 25 bp, E. coli
tgccgccaatgggtgtaataagttg

SEQ ID NO: 206603 - DNA, 25 bp, E. coli
gcgtggaaataatatcaccatcgtg

SEQ ID NO: 206604 - DNA, 25 bp, E. coli
gcaggtttacgcaaaatgccgctca

SEQ ID NO: 206605 - DNA, 25 bp, E. coli
gctgacgaaaccgtttgcgtggaaa

SEQ ID NO: 206606 - DNA, 25 bp, E. coli
gcgtggaaataaaatcaccatcgtg

SEQ ID NO: 206607 - DNA, 25 bp, E. coli
gctgacgaaaccctttgcgtggaaa

SEQ ID NO: 206608 - DNA, 25 bp, E. coli
gcaggtttacgctaaatgccgctca

SEQ ID NO: 206609 - DNA, 25 bp, E. coli
gaaacgggcgtctttataaagaatc

SEQ ID NO: 206610 - DNA, 25 bp, E. coli
gaaacgggcgtcattataaagaatc

SEQ ID NO: 206611 - DNA, 25 bp, E. coli
tctaagctttcggtgtacccaaggg

SEQ ID NO: 206612 - DNA, 25 bp, E. coli
tctaagctttcgctgtacccaaggg

SEQ ID NO: 206613 - DNA, 25 bp, E. coli
ggacgcgcacgacacagagaattaa

SEQ ID NO: 206614 - DNA, 25 bp, E. coli
ggacgcgcacgagacagagaattaa

SEQ ID NO: 206615 - DNA, 25 bp, E. coli
taataagttgccttctggcgcaggt

SEQ ID NO: 206616 - DNA, 25 bp, E. coli
taataagttgccatctggcgcaggt

SEQ ID NO: 206617 - DNA, 25 bp, E. coli
caattacgccgtattacaggaacgc

SEQ ID NO: 206618 - DNA, 25 bp, E. coli
caattacgccgttttacaggaacgc

SEQ ID NO: 206619 - DNA, 25 bp, E. coli
attacgccgtataacaggaacgccg

SEQ ID NO: 206620 - DNA, 25 bp, E. coli
attacgccgtattacaggaacgccg

SEQ ID NO: 206621 - DNA, 25 bp, E. coli
tattacaggaacgccgtttgaagca

SEQ ID NO: 206622 - DNA, 25 bp, E. coli
tacgccgtattacaggaacgccgtt

SEQ ID NO: 206623 - DNA, 25 bp, E. coli
tacgccgtattagaggaacgccgtt

SEQ ID NO: 206624 - DNA, 25 bp, E. coli
tattacaggaaccccgtttgaagca

SEQ ID NO: 206625 - DNA, 25 bp, E. coli
ttacgccgtattacaggaacgccgt

SEQ ID NO: 206626 - DNA, 25 bp, E. coli
ttacgccgtatttcaggaacgccgt

SEQ ID NO: 206627 - DNA, 25 bp, E. coli
gccgtattacaggaacgccgtttga

SEQ ID NO: 206628 - DNA, 25 bp, E. coli
gccgtattacagcaacgccgtttga

SEQ ID NO: 206629 - DNA, 25 bp, E. coli
gcaattacgccgtattacaggaacg

SEQ ID NO: 206630 - DNA, 25 bp, E. coli
gcaattacgccgaattacaggaacg

SEQ ID NO: 206631 - DNA, 25 bp, E. coli
cgccgtattacaggaacgccgtttg

SEQ ID NO: 206632 - DNA, 25 bp, E. coli
cgccgtattacacgaacgccgtttg

SEQ ID NO: 206633 - DNA, 25 bp, E. coli
cgtattacaggaacgccgtttgaag

SEQ ID NO: 206634 - DNA, 25 bp, E. coli
cgtattacaggatcgccgtttgaag

SEQ ID NO: 206635 - DNA, 25 bp, E. coli
gtattacaggaacgccgtttgaagc

SEQ ID NO: 206636 - DNA, 25 bp, E. coli
gtattacaggaaggccgtttgaagc

SEQ ID NO: 206637 - DNA, 25 bp, E. coli
taaatggatgttccagcgccatgcg

SEQ ID NO: 206638 - DNA, 25 bp, E. coli
tactcgacggcgatgctcaaaggca

SEQ ID NO: 206639 - DNA, 25 bp, E. coli
taaatggatgttgcagcgccatgcg

SEQ ID NO: 206640 - DNA, 25 bp, E. coli
tactcgacggcgttgctcaaaggca

SEQ ID NO: 206641 - DNA, 25 bp, E. coli
tacccagaatctggcgcggatggcg

SEQ ID NO: 206642 - DNA, 25 bp, E. coli
tatccgctgaaaggctactcgctga

SEQ ID NO: 206643 - DNA, 25 bp, E. coli
tacccagaatctcgcgcggatggcg

SEQ ID NO: 206644 - DNA, 25 bp, E. coli
tatccgctgaaacgctactcgctga

SEQ ID NO: 206645 - DNA, 25 bp, E. coli
ttgcgcgccgaatccaatattcagt

SEQ ID NO: 206646 - DNA, 25 bp, E. coli
ttgcgcgccgaaaccaatattcagt

SEQ ID NO: 206647 - DNA, 25 bp, E. coli
tgattgcctgaaagcattgcgcgcc

SEQ ID NO: 206648 - DNA, 25 bp, E. coli
tgttacgtaactccgacaccagcca

SEQ ID NO: 206649 - DNA, 25 bp, E. coli
tgttacgtaactgcgacaccagcca

SEQ ID NO: 206650 - DNA, 25 bp, E. coli
tgattgcctgaatgcattgcgcgcc

SEQ ID NO: 206651 - DNA, 25 bp, E. coli
tgaccaactgctttgcgacggcgag

SEQ ID NO: 206652 - DNA, 25 bp, E. coli
tgaccaactgctatgcgacggcgag

SEQ ID NO: 206653 - DNA, 25 bp, E. coli
tcaggcaggacaagaggtcaccgtc

SEQ ID NO: 206654 - DNA, 25 bp, E. coli
tcaggcaggacatgaggtcaccgtc

SEQ ID NO: 206655 - DNA, 25 bp, E. coli
cgacggtacgcacttccagttgaaa

SEQ ID NO: 206656 - DNA, 25 bp, E. coli
cgacggtacgcagttccagttgaaa

SEQ ID NO: 206657 - DNA, 25 bp, E. coli
gagctgttgcaagcgcgtcgtgaaa

SEQ ID NO: 206658 - DNA, 25 bp, E. coli
gagctgttgcaaccgcgtcgtgaaa

SEQ ID NO: 206659 - DNA, 25 bp, E. coli
caccgagatctaatgtgcagttatt

SEQ ID NO: 206660 - DNA, 25 bp, E. coli
caccgagatctattgtgcagttatt

SEQ ID NO: 206661 - DNA, 25 bp, E. coli
atacatcacggagtttattttgcag

SEQ ID NO: 206662 - DNA, 25 bp, E. coli
atacatcacggactttattttgcag

SEQ ID NO: 206663 - DNA, 25 bp, E. coli
tctggctggtggcataggtggcgtc

SEQ ID NO: 206664 - DNA, 25 bp, E. coli
tctggctggtgggataggtggcgtc

SEQ ID NO: 206665 - DNA, 25 bp, E. coli
cctgcgttgttaaccggtgtaatgg

SEQ ID NO: 206666 - DNA, 25 bp, E. coli
cctgcgttgttatccggtgtaatgg

SEQ ID NO: 206667 - DNA, 25 bp, E. coli
gcagttattgtacatattaagggca

SEQ ID NO: 206668 - DNA, 25 bp, E. coli
gcttcctcggagttgtttgaaaaca

SEQ ID NO: 206669 - DNA, 25 bp, E. coli
gcagttattgtagatattaagggca

SEQ ID NO: 206670 - DNA, 25 bp, E. coli
gcttcctcggagatgtttgaaaaca

SEQ ID NO: 206671 - DNA, 25 bp, E. coli
gaaccgctggttgtttgggtgataa

SEQ ID NO: 206672 - DNA, 25 bp, E. coli
gaaccgctggttctttgggtgataa

SEQ ID NO: 206673 - DNA, 25 bp, E. coli
ccggtgtaatggttgcctgtctgcc

SEQ ID NO: 206674 - DNA, 25 bp, E. coli
ccggtgtaatggatgcctgtctgcc

SEQ ID NO: 206675 - DNA, 25 bp, E. coli
gggagctattcctgcgttgttaacc

SEQ ID NO: 206676 - DNA, 25 bp, E. coli
gggagctattccagcgttgttaacc

SEQ ID NO: 206677 - DNA, 25 bp, E. coli
tgggtgataatacatccaatttttc

SEQ ID NO: 206678 - DNA, 25 bp, E. coli
tgggtgataatagatccaatttttc

SEQ ID NO: 206679 - DNA, 25 bp, E. coli
taagggcatggcttcctcggagttg

SEQ ID NO: 206680 - DNA, 25 bp, E. coli
taagggcatggcatcctcggagttg

SEQ ID NO: 206681 - DNA, 25 bp, E. coli
caacgtaaagattcgggttatctgc

SEQ ID NO: 206682 - DNA, 25 bp, E. coli
caacgtaaagatacgggttatctgc

SEQ ID NO: 206683 - DNA, 25 bp, E. coli
cagccatcctcttttctgatgggta

SEQ ID NO: 206684 - DNA, 25 bp, E. coli
cagccatcctctattctgatgggta

SEQ ID NO: 206685 - DNA, 25 bp, E. coli
ttctcgcttcaaattcgaccagcca

SEQ ID NO: 206686 - DNA, 25 bp, E. coli
ttcgaccagccaacctctattctga

SEQ ID NO: 206687 - DNA, 25 bp, E. coli
ttcgaccagccatcctctattctga

SEQ ID NO: 206688 - DNA, 25 bp, E. coli
ttctcgcttcaatttcgaccagcca

SEQ ID NO: 206689 - DNA, 25 bp, E. coli
tgaacgtaaggcaacgtaaagatac

SEQ ID NO: 206690 - DNA, 25 bp, E. coli
tgaacgtaaggctacgtaaagatac

SEQ ID NO: 206691 - DNA, 25 bp, E. coli
gccccgtctgaacgtaaggcaacgt

SEQ ID NO: 206692 - DNA, 25 bp, E. coli
gcttcggccccgtctgaacgtaagg

SEQ ID NO: 206693 - DNA, 25 bp, E. coli
gccccgtctgaaggtaaggcaacgt

SEQ ID NO: 206694 - DNA, 25 bp, E. coli
gcttcggccccgactgaacgtaagg

SEQ ID NO: 206695 - DNA, 25 bp, E. coli
ctctattctgatcggtatttaccac

SEQ ID NO: 206696 - DNA, 25 bp, E. coli
ctctattctgatgggtatttaccac

SEQ ID NO: 206697 - DNA, 25 bp, E. coli
cgtctgaacgtatggcaacgtaaag

SEQ ID NO: 206698 - DNA, 25 bp, E. coli
cgtctgaacgtaaggcaacgtaaag

SEQ ID NO: 206699 - DNA, 25 bp, E. coli
tcggccccgtctcaacgtaaggcaa

SEQ ID NO: 206700 - DNA, 25 bp, E. coli
tcggccccgtctgaacgtaaggcaa

SEQ ID NO: 206701 - DNA, 25 bp, E. coli
gaccagccatccactattctgatgg

SEQ ID NO: 206702 - DNA, 25 bp, E. coli
gaccagccatcctctattctgatgg

SEQ ID NO: 206703 - DNA, 25 bp, E. coli
aataccccggagacgaaacagtcag

SEQ ID NO: 206704 - DNA, 25 bp, E. coli
aataccccggagtcgaaacagtcag

SEQ ID NO: 206705 - DNA, 25 bp, E. coli
caggcgcgcctcttgtcggtattga

SEQ ID NO: 206706 - DNA, 25 bp, E. coli
caggcgcgcctcatgtcggtattga

SEQ ID NO: 206707 - DNA, 25 bp, E. coli
agtgctgatactcttcttcgcaggg

SEQ ID NO: 206708 - DNA, 25 bp, E. coli
attataacgccacccggataatggc

SEQ ID NO: 206709 - DNA, 25 bp, E. coli
agtgctgatactgttcttcgcaggg

SEQ ID NO: 206710 - DNA, 25 bp, E. coli
agaaccatctgtgcctgcagcatcg

SEQ ID NO: 206711 - DNA, 25 bp, E. coli
agaaccatctgtccctgcagcatcg

SEQ ID NO: 206712 - DNA, 25 bp, E. coli
attataacgccagccggataatggc

SEQ ID NO: 206713 - DNA, 25 bp, E. coli
ttcgcagggttatcaataccccgga

SEQ ID NO: 206714 - DNA, 25 bp, E. coli
ttcgcagggttaacaataccccgga

SEQ ID NO: 206715 - DNA, 25 bp, E. coli
gaaatcacctgatccagaaccatct

SEQ ID NO: 206716 - DNA, 25 bp, E. coli
gaaatcacctgaaccagaaccatct

SEQ ID NO: 206717 - DNA, 25 bp, E. coli
cgtcttgttgcctgtgagttgtcac

SEQ ID NO: 206718 - DNA, 25 bp, E. coli
cgtcttgttgccagtgagttgtcac

SEQ ID NO: 206719 - DNA, 25 bp, E. coli
gtgggtctccgttgcagtgctgata

SEQ ID NO: 206720 - DNA, 25 bp, E. coli
gtgggtctccgtagcagtgctgata

SEQ ID NO: 206721 - DNA, 25 bp, E. coli
ggccaccgttactgtacgttaatcg

SEQ ID NO: 206722 - DNA, 25 bp, E. coli
ggccaccgttacagtacgttaatcg

SEQ ID NO: 206723 - DNA, 25 bp, E. coli
gagttgtcaccaaagaaatcacctg

SEQ ID NO: 206724 - DNA, 25 bp, E. coli
gagttgtcaccatagaaatcacctg

SEQ ID NO: 206725 - DNA, 25 bp, E. coli
aattatcgcgacacatatggaggcc

SEQ ID NO: 206726 - DNA, 25 bp, E. coli
aattatcgcgactcatatggaggcc

SEQ ID NO: 206727 - DNA, 25 bp, E. coli
taccgacgagactaaatttggcgat

SEQ ID NO: 206728 - DNA, 25 bp, E. coli
taccgacgagacaaaatttggcgat

SEQ ID NO: 206729 - DNA, 25 bp, E. coli
tatggaggccgttaaccactgtttg

SEQ ID NO: 206730 - DNA, 25 bp, E. coli
tatggaggccgtaaaccactgtttg

SEQ ID NO: 206731 - DNA, 25 bp, E. coli
tgacgacgtcgacgctacaatgcta

SEQ ID NO: 206732 - DNA, 25 bp, E. coli
tgacgacgtcgaggctacaatgcta

SEQ ID NO: 206733 - DNA, 25 bp, E. coli
tgcataaaacgacagggcagcacgg

SEQ ID NO: 206734 - DNA, 25 bp, E. coli
tgcataaaacgagagggcagcacgg

SEQ ID NO: 206735 - DNA, 25 bp, E. coli
tcgcgcctaaagcaagttatccggg

SEQ ID NO: 206736 - DNA, 25 bp, E. coli
tcgcgcctaaaggaagttatccggg

SEQ ID NO: 206737 - DNA, 25 bp, E. coli
ccagaagtggttctgttgaatgccg

SEQ ID NO: 206738 - DNA, 25 bp, E. coli
ccagaagtggttgtgttgaatgccg

SEQ ID NO: 206739 - DNA, 25 bp, E. coli
gaagatcactgggacgaaacagcct

SEQ ID NO: 206740 - DNA, 25 bp, E. coli
gaagatcactggcacgaaacagcct

SEQ ID NO: 206741 - DNA, 25 bp, E. coli
cgcgtcgtccctaaagataaactga

SEQ ID NO: 206742 - DNA, 25 bp, E. coli
cgcgtcgtcccttaagataaactga

SEQ ID NO: 206743 - DNA, 25 bp, E. coli
gagaaaacgctctatctggctggcg

SEQ ID NO: 206744 - DNA, 25 bp, E. coli
gatgcgctcaaggaatacgccagag

SEQ ID NO: 206745 - DNA, 25 bp, E. coli
gagaaaacgctcaatctggctggcg

SEQ ID NO: 206746 - DNA, 25 bp, E. coli
gatgcgctcaagcaatacgccagag

SEQ ID NO: 206747 - DNA, 25 bp, E. coli
atattcagccggtcgcagcaggatc

SEQ ID NO: 206748 - DNA, 25 bp, E. coli
atattcagccggacgcagcaggatc

SEQ ID NO: 206749 - DNA, 25 bp, E. coli
tataggctttctggactgcagcgtc

SEQ ID NO: 206750 - DNA, 25 bp, E. coli
tataggctttctcgactgcagcgtc

SEQ ID NO: 206751 - DNA, 25 bp, E. coli
gccagggcgtcacaaatgtagtcac

SEQ ID NO: 206752 - DNA, 25 bp, E. coli
gcgcagtaccgtcggtggcttcaaa

SEQ ID NO: 206753 - DNA, 25 bp, E. coli
gcgcagtaccgtgggtggcttcaaa

SEQ ID NO: 206754 - DNA, 25 bp, E. coli
gccagggcgtcagaaatgtagtcac

SEQ ID NO: 206755 - DNA, 25 bp, E. coli
gcagggcaacgtacagagagcgaat

SEQ ID NO: 206756 - DNA, 25 bp, E. coli
gcagggcaacgttcagagagcgaat

SEQ ID NO: 206757 - DNA, 25 bp, E. coli
gatcgctgcacgtaccagacgtttg

SEQ ID NO: 206758 - DNA, 25 bp, E. coli
gatagtaacgtagcggacgcaggca

SEQ ID NO: 206759 - DNA, 25 bp, E. coli
gatagtaacgtaccggacgcaggca

SEQ ID NO: 206760 - DNA, 25 bp, E. coli
gatcttcttgccatgtgccggaaca

SEQ ID NO: 206761 - DNA, 25 bp, E. coli
tggcttcaaacagggcgcattcgtc

SEQ ID NO: 206762 - DNA, 25 bp, E. coli
tggcttcaaacacggcgcattcgtc

SEQ ID NO: 206763 - DNA, 25 bp, E. coli
taaccatatcggacagttcagggtg

SEQ ID NO: 206764 - DNA, 25 bp, E. coli
taaccatatcggtcagttcagggtg

SEQ ID NO: 206765 - DNA, 25 bp, E. coli
gatcttcttgccttgtgccggaaca

SEQ ID NO: 206766 - DNA, 25 bp, E. coli
gacgtcctgaccataaacctgtgtg

SEQ ID NO: 206767 - DNA, 25 bp, E. coli
gacgtcctgaccttaaacctgtgtg

SEQ ID NO: 206768 - DNA, 25 bp, E. coli
gatcgctgcacgaaccagacgtttg

SEQ ID NO: 206769 - DNA, 25 bp, E. coli
aatgtatcctcatgcaacatgacgg

SEQ ID NO: 206770 - DNA, 25 bp, E. coli
aatgtatcctcaagcaacatgacgg

SEQ ID NO: 206771 - DNA, 25 bp, E. coli
tactgataagtcgaaaagtgttagt

SEQ ID NO: 206772 - DNA, 25 bp, E. coli
tactgataagtccaaaagtgttagt

SEQ ID NO: 206773 - DNA, 25 bp, E. coli
acataacggacaagatcgccactgg

SEQ ID NO: 206774 - DNA, 25 bp, E. coli
acataacggacatgatcgccactgg

SEQ ID NO: 206775 - DNA, 25 bp, E. coli
tgttgctattcctttcctcccaggt

SEQ ID NO: 206776 - DNA, 25 bp, E. coli
tgttgctattccattcctcccaggt

SEQ ID NO: 206777 - DNA, 25 bp, E. coli
taagccccgaaagcagttctctaat

SEQ ID NO: 206778 - DNA, 25 bp, E. coli
taagccccgaaaccagttctctaat

SEQ ID NO: 206779 - DNA, 25 bp, E. coli
tctctaatttcttcttcactttggg

SEQ ID NO: 206780 - DNA, 25 bp, E. coli
tctctaatttctacttcactttggg

SEQ ID NO: 206781 - DNA, 25 bp, E. coli
cccaggtcgtgaaggtgatttcagg

SEQ ID NO: 206782 - DNA, 25 bp, E. coli
cgcgagtcaggtaattattcaactc

SEQ ID NO: 206783 - DNA, 25 bp, E. coli
cgcgagtcaggttattattcaactc

SEQ ID NO: 206784 - DNA, 25 bp, E. coli
cccaggtcgtgatggtgatttcagg

SEQ ID NO: 206785 - DNA, 25 bp, E. coli
cgttaatttcagacaatgtatcctc

SEQ ID NO: 206786 - DNA, 25 bp, E. coli
cgttaatttcagtcaatgtatcctc

SEQ ID NO: 206787 - DNA, 25 bp, E. coli
gatttcaggatcattgccggttgca

SEQ ID NO: 206788 - DNA, 25 bp, E. coli
gatttcaggatctttgccggttgca

SEQ ID NO: 206789 - DNA, 25 bp, E. coli
tcactttgggtactgataagtccaa

SEQ ID NO: 206790 - DNA, 25 bp, E. coli
tcactttgggtagtgataagtccaa

SEQ ID NO: 206791 - DNA, 25 bp, E. coli
cactggtaatggaaggcgctctggc

SEQ ID NO: 206792 - DNA, 25 bp, E. coli
cactggtaatggtaggcgctctggc

SEQ ID NO: 206793 - DNA, 25 bp, E. coli
atttcactggtattggaaggcgctc

SEQ ID NO: 206794 - DNA, 25 bp, E. coli
atttcactggtaatggaaggcgctc

SEQ ID NO: 206795 - DNA, 25 bp, E. coli
actggtaatggaaggcgctctggct

SEQ ID NO: 206796 - DNA, 25 bp, E. coli
actggtaatggatggcgctctggct

SEQ ID NO: 206797 - DNA, 25 bp, E. coli
tatttcactggttatggaaggcgct

SEQ ID NO: 206798 - DNA, 25 bp, E. coli
tatttcactggtaatggaaggcgct

SEQ ID NO: 206799 - DNA, 25 bp, E. coli
ttcactggtaatcgaaggcgctctg

SEQ ID NO: 206800 - DNA, 25 bp, E. coli
tttcactggtaaaggaaggcgctct

SEQ ID NO: 206801 - DNA, 25 bp, E. coli
ttcactggtaatggaaggcgctctg

SEQ ID NO: 206802 - DNA, 25 bp, E. coli
tttcactggtaatggaaggcgctct

SEQ ID NO: 206803 - DNA, 25 bp, E. coli
tgtgtttttgatcgagcgcctgggg

SEQ ID NO: 206804 - DNA, 25 bp, E. coli
tgtgtttttgatggagcgcctgggg

SEQ ID NO: 206805 - DNA, 25 bp, E. coli
ctggtaatggaaggcgctctggctg

SEQ ID NO: 206806 - DNA, 25 bp, E. coli
ctggtaatggaacgcgctctggctg

SEQ ID NO: 206807 - DNA, 25 bp, E. coli
gtttttgatggagcgcctggggaac

SEQ ID NO: 206808 - DNA, 25 bp, E. coli
gtttttgatggaccgcctggggaac

SEQ ID NO: 206809 - DNA, 25 bp, E. coli
tcactggtaatgcaaggcgctctgg

SEQ ID NO: 206810 - DNA, 25 bp, E. coli
tcactggtaatggaaggcgctctgg

SEQ ID NO: 206811 - DNA, 25 bp, E. coli
taatggaaggcgctctggctgttat

SEQ ID NO: 206812 - DNA, 25 bp, E. coli
taatggaaggcggtctggctgttat

SEQ ID NO: 206813 - DNA, 25 bp, E. coli
aagccaggtgcaccatatggtccgc

SEQ ID NO: 206814 - DNA, 25 bp, E. coli
aatccacaggcgcatgccgccgatg

SEQ ID NO: 206815 - DNA, 25 bp, E. coli
aatccacaggcggatgccgccgatg

SEQ ID NO: 206816 - DNA, 25 bp, E. coli
aacgctgactcacccctgaaactgg

SEQ ID NO: 206817 - DNA, 25 bp, E. coli
cacccactgccaggttagtcagaat

SEQ ID NO: 206818 - DNA, 25 bp, E. coli
cacccactgccacgttagtcagaat

SEQ ID NO: 206819 - DNA, 25 bp, E. coli
agtgccgaaaaaagccaggtgcagc

SEQ ID NO: 206820 - DNA, 25 bp, E. coli
agtgccgaaaaatgccaggtgcagc

SEQ ID NO: 206821 - DNA, 25 bp, E. coli
aggcaactgtcctacctgggtagcg

SEQ ID NO: 206822 - DNA, 25 bp, E. coli
aggcaactgtccaacctgggtagcg

SEQ ID NO: 206823 - DNA, 25 bp, E. coli
aagccaggtgcagcatatggtccgc

SEQ ID NO: 206824 - DNA, 25 bp, E. coli
aacgctgactcagccctgaaactgg

SEQ ID NO: 206825 - DNA, 25 bp, E. coli
tatggtccgcacgttgctgaaactg

SEQ ID NO: 206826 - DNA, 25 bp, E. coli
tatggtccgcaccttgctgaaactg

SEQ ID NO: 206827 - DNA, 25 bp, E. coli
tgaaactgcccgctaatccacaggc

SEQ ID NO: 206828 - DNA, 25 bp, E. coli
tgaaactgcccggtaatccacaggc

SEQ ID NO: 206829 - DNA, 25 bp, E. coli
tctatgcgggcgagacggaaatcat

SEQ ID NO: 206830 - DNA, 25 bp, E. coli
tctatgcgggcgtgacggaaatcat

SEQ ID NO: 206831 - DNA, 25 bp, E. coli
cgcaccaaagtggatgatttaccgt

SEQ ID NO: 206832 - DNA, 25 bp, E. coli
cgcaccaaagtgcatgatttaccgt

SEQ ID NO: 206833 - DNA, 25 bp, E. coli
gtggatgatttagcgtctcgtctga

SEQ ID NO: 206834 - DNA, 25 bp, E. coli
gtggatgatttaccgtctcgtctga

SEQ ID NO: 206835 - DNA, 25 bp, E. coli
aagctttagtggtcagcagcaggcc

SEQ ID NO: 206836 - DNA, 25 bp, E. coli
aagctttagtggacagcagcaggcc

SEQ ID NO: 206837 - DNA, 25 bp, E. coli
accgctgggttctcacgaatggcaa

SEQ ID NO: 206838 - DNA, 25 bp, E. coli
atatttcgctgttcacccgccaggg

SEQ ID NO: 206839 - DNA, 25 bp, E. coli
atatttcgctgtacacccgccaggg

SEQ ID NO: 206840 - DNA, 25 bp, E. coli
accgctgggttcacacgaatggcaa

SEQ ID NO: 206841 - DNA, 25 bp, E. coli
tagcagaagcccagagtaaagcgga

SEQ ID NO: 206842 - DNA, 25 bp, E. coli
tagcagaagccctgagtaaagcgga

SEQ ID NO: 206843 - DNA, 25 bp, E. coli
ttgctggtggcaacagataagccca

SEQ ID NO: 206844 - DNA, 25 bp, E. coli
ttagggcaaagctacatcagtggcg

SEQ ID NO: 206845 - DNA, 25 bp, E. coli
ttgctggtggcatcagataagccca

SEQ ID NO: 206846 - DNA, 25 bp, E. coli
ttagcgcccttgattaccgccgacg

SEQ ID NO: 206847 - DNA, 25 bp, E. coli
ttagcgcccttgtttaccgccgacg

SEQ ID NO: 206848 - DNA, 25 bp, E. coli
ttagggcaaagcaacatcagtggcg

SEQ ID NO: 206849 - DNA, 25 bp, E. coli
tgagcgaagcattagcaggcgagac

SEQ ID NO: 206850 - DNA, 25 bp, E. coli
tgagcgaagcataagcaggcgagac

SEQ ID NO: 206851 - DNA, 25 bp, E. coli
gctgcggtggctcacaaaaatacga

SEQ ID NO: 206852 - DNA, 25 bp, E. coli
gctgcggtggctgacaaaaatacga

SEQ ID NO: 206853 - DNA, 25 bp, E. coli
gacaatacgccctaagtgactgatg

SEQ ID NO: 206854 - DNA, 25 bp, E. coli
gacaatacgcccaaagtgactgatg

SEQ ID NO: 206855 - DNA, 25 bp, E. coli
gatccctgtggaagaaacaccgcct

SEQ ID NO: 206856 - DNA, 25 bp, E. coli
gatccctgtggatgaaacaccgcct

SEQ ID NO: 206857 - DNA, 25 bp, E. coli
agcactgctgccctgcattaaacag

SEQ ID NO: 206858 - DNA, 25 bp, E. coli
agcagcactgctcccctgcattaaa

SEQ ID NO: 206859 - DNA, 25 bp, E. coli
agcactgctgccgtgcattaaacag

SEQ ID NO: 206860 - DNA, 25 bp, E. coli
agcagcactgctgccctgcattaaa

SEQ ID NO: 206861 - DNA, 25 bp, E. coli
aaacaggccagggaagatatccgta

SEQ ID NO: 206862 - DNA, 25 bp, E. coli
aaacaggccaggcaagatatccgta

SEQ ID NO: 206863 - DNA, 25 bp, E. coli
actgctgccctggattaaacaggcc

SEQ ID NO: 206864 - DNA, 25 bp, E. coli
actgctgccctgcattaaacaggcc

SEQ ID NO: 206865 - DNA, 25 bp, E. coli
ttaaacaggccacggaagatatccg

SEQ ID NO: 206866 - DNA, 25 bp, E. coli
ttaaacaggccagggaagatatccg

SEQ ID NO: 206867 - DNA, 25 bp, E. coli
tgccctgcattaaacaggccaggga

SEQ ID NO: 206868 - DNA, 25 bp, E. coli
tgccctgcattatacaggccaggga

SEQ ID NO: 206869 - DNA, 25 bp, E. coli
cctgcattaaacaggccagggaaga

SEQ ID NO: 206870 - DNA, 25 bp, E. coli
cctgcattaaactggccagggaaga

SEQ ID NO: 206871 - DNA, 25 bp, E. coli
gctgccctgcataaaacaggccagg

SEQ ID NO: 206872 - DNA, 25 bp, E. coli
gctgccctgcattaaacaggccagg

SEQ ID NO: 206873 - DNA, 25 bp, E. coli
gcactgctgccctgcattaaacagg

SEQ ID NO: 206874 - DNA, 25 bp, E. coli
gcactgctgcccagcattaaacagg

SEQ ID NO: 206875 - DNA, 25 bp, E. coli
ctgcattaaacaggccagggaagat

SEQ ID NO: 206876 - DNA, 25 bp, E. coli
ctgcattaaacacgccagggaagat

SEQ ID NO: 206877 - DNA, 25 bp, E. coli
cattaaacaggcgagggaagatatc

SEQ ID NO: 206878 - DNA, 25 bp, E. coli
cattaaacaggccagggaagatatc

SEQ ID NO: 206879 - DNA, 25 bp, E. coli
caatgttcgcttctagatggcaaaa

SEQ ID NO: 206880 - DNA, 25 bp, E. coli
caatgttcgcttgtagatggcaaaa

SEQ ID NO: 206881 - DNA, 25 bp, E. coli
caacaatgttcggttgtagatggca

SEQ ID NO: 206882 - DNA, 25 bp, E. coli
cagcaagtccttatgatgagccgtc

SEQ ID NO: 206883 - DNA, 25 bp, E. coli
caccagtgcaccgaaaatcacggta

SEQ ID NO: 206884 - DNA, 25 bp, E. coli
caccagtgcacccaaaatcacggta

SEQ ID NO: 206885 - DNA, 25 bp, E. coli
caacaatgttcgcttgtagatggca

SEQ ID NO: 206886 - DNA, 25 bp, E. coli
cagcaagtccttttgatgagccgtc

SEQ ID NO: 206887 - DNA, 25 bp, E. coli
taaagagaagcatcaatgttcgctt

SEQ ID NO: 206888 - DNA, 25 bp, E. coli
taaagagaagcaacaatgttcgctt

SEQ ID NO: 206889 - DNA, 25 bp, E. coli
tgggtgtgatatacatgttcatcac

SEQ ID NO: 206890 - DNA, 25 bp, E. coli
tgggtgtgatattcatgttcatcac

SEQ ID NO: 206891 - DNA, 25 bp, E. coli
tccctgggtgtgttattcatgttca

SEQ ID NO: 206892 - DNA, 25 bp, E. coli
tccttatgatgagccgtcataactt

SEQ ID NO: 206893 - DNA, 25 bp, E. coli
tccctgggtgtgatattcatgttca

SEQ ID NO: 206894 - DNA, 25 bp, E. coli
tccttatgatgacccgtcataactt

SEQ ID NO: 206895 - DNA, 25 bp, E. coli
gcaccgtcgcgagcgcgcagttctt

SEQ ID NO: 206896 - DNA, 25 bp, E. coli
gcaccgtcgcgaccgcgcagttctt

SEQ ID NO: 206897 - DNA, 25 bp, E. coli
gaaaatcacggttttagttgggcac

SEQ ID NO: 206898 - DNA, 25 bp, E. coli
gaaaatcacggtattagttgggcac

SEQ ID NO: 206899 - DNA, 25 bp, E. coli
cggtgggcagctgaccactaaaggg

SEQ ID NO: 206900 - DNA, 25 bp, E. coli
cggtgggcagctcaccactaaaggg

SEQ ID NO: 206901 - DNA, 25 bp, E. coli
cactactggagacaacggcggtttt

SEQ ID NO: 206902 - DNA, 25 bp, E. coli
cagcagattcgcgagttagaggaga

SEQ ID NO: 206903 - DNA, 25 bp, E. coli
cagcagattcgccagttagaggaga

SEQ ID NO: 206904 - DNA, 25 bp, E. coli
cactactggagagaacggcggtttt

SEQ ID NO: 206905 - DNA, 25 bp, E. coli
taaacgggcgatacatgatgttgcc

SEQ ID NO: 206906 - DNA, 25 bp, E. coli
taaacgggcgattcatgatgttgcc

SEQ ID NO: 206907 - DNA, 25 bp, E. coli
agcgattgccacacaacatgacggg

SEQ ID NO: 206908 - DNA, 25 bp, E. coli
agcgattgccactcaacatgacggg

SEQ ID NO: 206909 - DNA, 25 bp, E. coli
taggcgtgccgctgtttgaccgtag

SEQ ID NO: 206910 - DNA, 25 bp, E. coli
taggcgtgccgcagtttgaccgtag

SEQ ID NO: 206911 - DNA, 25 bp, E. coli
tagcgttagtcgaggcgcaacatca

SEQ ID NO: 206912 - DNA, 25 bp, E. coli
tagcgttagtcgtggcgcaacatca

SEQ ID NO: 206913 - DNA, 25 bp, E. coli
ttgaccactactgcgagaaagcggg

SEQ ID NO: 206914 - DNA, 25 bp, E. coli
ttgaccactactccgagaaagcggg

SEQ ID NO: 206915 - DNA, 25 bp, E. coli
tgaaaaactggtgctgctcagcgcg

SEQ ID NO: 206916 - DNA, 25 bp, E. coli
tgaaaaactggtcctgctcagcgcg

SEQ ID NO: 206917 - DNA, 25 bp, E. coli
tccacattgttaccagcagcgattg

SEQ ID NO: 206918 - DNA, 25 bp, E. coli
tccacaggtggtcattgaggcgaac

SEQ ID NO: 206919 - DNA, 25 bp, E. coli
tccacaggtggtgattgaggcgaac

SEQ ID NO: 206920 - DNA, 25 bp, E. coli
tccacattgttagcagcagcgattg

SEQ ID NO: 206921 - DNA, 25 bp, E. coli
tcactgatgcagcagaagtctggcg

SEQ ID NO: 206922 - DNA, 25 bp, E. coli
tcactgatgcaggagaagtctggcg

SEQ ID NO: 206923 - DNA, 25 bp, E. coli
caagatccccagctgatggcagcga

SEQ ID NO: 206924 - DNA, 25 bp, E. coli
aattggctacgacattttgcagggc

SEQ ID NO: 206925 - DNA, 25 bp, E. coli
aattggctacgagattttgcagggc

SEQ ID NO: 206926 - DNA, 25 bp, E. coli
caagatccccaggtgatggcagcga

SEQ ID NO: 206927 - DNA, 25 bp, E. coli
caaaggcaacgtcgtgatcatcaac

SEQ ID NO: 206928 - DNA, 25 bp, E. coli
caaaggcaacgtggtgatcatcaac

SEQ ID NO: 206929 - DNA, 25 bp, E. coli
agattgaagcccatagtgaccgcgc

SEQ ID NO: 206930 - DNA, 25 bp, E. coli
agattgaagcccttagtgaccgcgc

SEQ ID NO: 206931 - DNA, 25 bp, E. coli
aaaaccgcgtcgtaggatgccagac

SEQ ID NO: 206932 - DNA, 25 bp, E. coli
aaaaccgcgtcgaaggatgccagac

SEQ ID NO: 206933 - DNA, 25 bp, E. coli
ttattgtcggtgtggacggaagccc

SEQ ID NO: 206934 - DNA, 25 bp, E. coli
ttattgtcggtgaggacggaagccc

SEQ ID NO: 206935 - DNA, 25 bp, E. coli
ttcgtgcagatcaccaaaggcgcgg

SEQ ID NO: 206936 - DNA, 25 bp, E. coli
ttcgtgcagatctccaaaggcgcgg

SEQ ID NO: 206937 - DNA, 25 bp, E. coli
tgacaaccagaacgcgaaaggcagt

SEQ ID NO: 206938 - DNA, 25 bp, E. coli
tgacaaccagaaggcgaaaggcagt

SEQ ID NO: 206939 - DNA, 25 bp, E. coli
tcggcaattacaaaggctggacggt

SEQ ID NO: 206940 - DNA, 25 bp, E. coli
tcggcaattacataggctggacggt

SEQ ID NO: 206941 - DNA, 25 bp, E. coli
gatatgattatcctcaacgctgccg

SEQ ID NO: 206942 - DNA, 25 bp, E. coli
gatatgattatcgtcaacgctgccg

SEQ ID NO: 206943 - DNA, 25 bp, E. coli
tcaataggcgtaacggtgggcgatc

SEQ ID NO: 206944 - DNA, 25 bp, E. coli
tcaataggcgtatcggtgggcgatc

SEQ ID NO: 206945 - DNA, 25 bp, E. coli
cacaactgcgcgtttcggctatcaa

SEQ ID NO: 206946 - DNA, 25 bp, E. coli
cacaactgcgcgattcggctatcaa

SEQ ID NO: 206947 - DNA, 25 bp, E. coli
caggttttccatcgcgaaggcattc

SEQ ID NO: 206948 - DNA, 25 bp, E. coli
cagtgattcactacgcgctgtggaa

SEQ ID NO: 206949 - DNA, 25 bp, E. coli
cagtgattcacttcgcgctgtggaa

SEQ ID NO: 206950 - DNA, 25 bp, E. coli
caggttttccatggcgaaggcattc

SEQ ID NO: 206951 - DNA, 25 bp, E. coli
taaacgatttgcctgaatggctgcg

SEQ ID NO: 206952 - DNA, 25 bp, E. coli
taaacgatttgcgtgaatggctgcg

SEQ ID NO: 206953 - DNA, 25 bp, E. coli
tacgcgttgccgaactggagcagcg

SEQ ID NO: 206954 - DNA, 25 bp, E. coli
tacgcgttgccgtactggagcagcg

SEQ ID NO: 206955 - DNA, 25 bp, E. coli
tatcgcttttgataatcgcctgggc

SEQ ID NO: 206956 - DNA, 25 bp, E. coli
tatcgcttttgaaaatcgcctgggc

SEQ ID NO: 206957 - DNA, 25 bp, E. coli
tctgggattatcagcatcacgcgct

SEQ ID NO: 206958 - DNA, 25 bp, E. coli
tctgggattatctgcatcacgcgct

SEQ ID NO: 206959 - DNA, 25 bp, E. coli
gctatgagcgtacccgcaagcacag

SEQ ID NO: 206960 - DNA, 25 bp, E. coli
gctatgagcgtagccgcaagcacag

SEQ ID NO: 206961 - DNA, 25 bp, E. coli
cgtcttggcgtcaggcaggacattc

SEQ ID NO: 206962 - DNA, 25 bp, E. coli
cgtcttggcgtctggcaggacattc

SEQ ID NO: 206963 - DNA, 25 bp, E. coli
gttgcgcaacaatgccgatattccg

SEQ ID NO: 206964 - DNA, 25 bp, E. coli
gttgcgcaacaaagccgatattccg

SEQ ID NO: 206965 - DNA, 25 bp, E. coli
gggagaaaatgataccttcctgacg

SEQ ID NO: 206966 - DNA, 25 bp, E. coli
gggagaaaatgaaaccttcctgacg

SEQ ID NO: 206967 - DNA, 25 bp, E. coli
taactatattggaccggaactgccg

SEQ ID NO: 206968 - DNA, 25 bp, E. coli
tattacgtctgaaaggacatgtcgc

SEQ ID NO: 206969 - DNA, 25 bp, E. coli
tattccttaaagactggcggccgaa

SEQ ID NO: 206970 - DNA, 25 bp, E. coli
tattacgtctgataggacatgtcgc

SEQ ID NO: 206971 - DNA, 25 bp, E. coli
tttaaagcgttaattgctccgggcg

SEQ ID NO: 206972 - DNA, 25 bp, E. coli
tttaaagcgttatttgctccgggcg

SEQ ID NO: 206973 - DNA, 25 bp, E. coli
tattccttaaagtctggcggccgaa

SEQ ID NO: 206974 - DNA, 25 bp, E. coli
tgggcctgggcttcaaaccgttata

SEQ ID NO: 206975 - DNA, 25 bp, E. coli
tgtataaattaagcgttgccagcgg

SEQ ID NO: 206976 - DNA, 25 bp, E. coli
tgtataaattaaccgttgccagcgg

SEQ ID NO: 206977 - DNA, 25 bp, E. coli
tgggcctgggctacaaaccgttata

SEQ ID NO: 206978 - DNA, 25 bp, E. coli
tccgggcggcgcgttttattcactg

SEQ ID NO: 206979 - DNA, 25 bp, E. coli
tccgggcggcgccttttattcactg

SEQ ID NO: 206980 - DNA, 25 bp, E. coli
tctggaccatgatgccgtttaaagc

SEQ ID NO: 206981 - DNA, 25 bp, E. coli
tctggaccatgaagccgtttaaagc

SEQ ID NO: 206982 - DNA, 25 bp, E. coli
gcggtcccgtgcgttcagaatatag

SEQ ID NO: 206983 - DNA, 25 bp, E. coli
gcggtcccgtgccttcagaatatag

SEQ ID NO: 206984 - DNA, 25 bp, E. coli
gaatcgatccgtaccacattggcgc

SEQ ID NO: 206985 - DNA, 25 bp, E. coli
gaatcgatccgttccacattggcgc

SEQ ID NO: 206986 - DNA, 25 bp, E. coli
ggcaatcagcatgggacaatccgca

SEQ ID NO: 206987 - DNA, 25 bp, E. coli
ggcaatcagcatcggacaatccgca

SEQ ID NO: 206988 - DNA, 25 bp, E. coli
taactatattggtccggaactgccg

SEQ ID NO: 206989 - DNA, 25 bp, E. coli
aaattgccgccattttaccgctgca

SEQ ID NO: 206990 - DNA, 25 bp, E. coli
aaattgccgccaatttaccgctgca

SEQ ID NO: 206991 - DNA, 25 bp, E. coli
tatgccgattatgaacgcgcggtcg

SEQ ID NO: 206992 - DNA, 25 bp, E. coli
tatgccgattatcaacgcgcggtcg

SEQ ID NO: 206993 - DNA, 25 bp, E. coli
ttaatactcccggagagacgctcga

SEQ ID NO: 206994 - DNA, 25 bp, E. coli
ttaatactcccgcagagacgctcga

SEQ ID NO: 206995 - DNA, 25 bp, E. coli
tgagcgatctgcataacgagtccat

SEQ ID NO: 206996 - DNA, 25 bp, E. coli
tgagcgatctgcttaacgagtccat

SEQ ID NO: 206997 - DNA, 25 bp, E. coli
tccatttttatttccggcggcggat

SEQ ID NO: 206998 - DNA, 25 bp, E. coli
tcgaaaccggctaccacgagctgtt

SEQ ID NO: 206999 - DNA, 25 bp, E. coli
tcgaaaccggcttccacgagctgtt

SEQ ID NO: 207000 - DNA, 25 bp, E. coli
tccatttttattaccggcggcggat

SEQ ID NO: 207001 - DNA, 25 bp, E. coli
tctgggatcacattgcctcactggt

SEQ ID NO: 207002 - DNA, 25 bp, E. coli
tctgggatcacaatgcctcactggt

SEQ ID NO: 207003 - DNA, 25 bp, E. coli
gcaataatcgcggattaagcggtgt

SEQ ID NO: 207004 - DNA, 25 bp, E. coli
gcaataatcgcgcattaagcggtgt

SEQ ID NO: 207005 - DNA, 25 bp, E. coli
gatttatcgaagaaggcgcgcaggt

SEQ ID NO: 207006 - DNA, 25 bp, E. coli
gatcagatcctgtctcgttccggca

SEQ ID NO: 207007 - DNA, 25 bp, E. coli
gatcagatcctgactcgttccggca

SEQ ID NO: 207008 - DNA, 25 bp, E. coli
gatttatcgaagtaggcgcgcaggt

SEQ ID NO: 207009 - DNA, 25 bp, E. coli
taatgcagtctcagacgccggagaa

SEQ ID NO: 207010 - DNA, 25 bp, E. coli
taatgcagtctctgacgccggagaa

SEQ ID NO: 207011 - DNA, 25 bp, E. coli
agttgccagtcaccaaaacgaagcg

SEQ ID NO: 207012 - DNA, 25 bp, E. coli
agttgccagtcagcaaaacgaagcg

SEQ ID NO: 207013 - DNA, 25 bp, E. coli
aaagttgccagtcagcaaaacgaag

SEQ ID NO: 207014 - DNA, 25 bp, E. coli
aaagttgccagtgagcaaaacgaag

SEQ ID NO: 207015 - DNA, 25 bp, E. coli
ttgccagtcagcaaaacgaagcgca

SEQ ID NO: 207016 - DNA, 25 bp, E. coli
ttgccagtcagctaaacgaagcgca

SEQ ID NO: 207017 - DNA, 25 bp, E. coli
ttcgttcagtgctggcaaagttgcc

SEQ ID NO: 207018 - DNA, 25 bp, E. coli
ttcgttcagtgcaggcaaagttgcc

SEQ ID NO: 207019 - DNA, 25 bp, E. coli
tgctggcaaagttgccagtcagcaa

SEQ ID NO: 207020 - DNA, 25 bp, E. coli
tgctggcaaagtagccagtcagcaa

SEQ ID NO: 207021 - DNA, 25 bp, E. coli
tcgttcagtgctggcaaagttgcca

SEQ ID NO: 207022 - DNA, 25 bp, E. coli
tcgttcagtgctcgcaaagttgcca

SEQ ID NO: 207023 - DNA, 25 bp, E. coli
tcagtgctggcatagttgccagtca

SEQ ID NO: 207024 - DNA, 25 bp, E. coli
tcagtgctggcaaagttgccagtca

SEQ ID NO: 207025 - DNA, 25 bp, E. coli
gcaaagttgccagtcagcaaaacga

SEQ ID NO: 207026 - DNA, 25 bp, E. coli
gcaaagttgccactcagcaaaacga

SEQ ID NO: 207027 - DNA, 25 bp, E. coli
gttgccagtcagcaaaacgaagcgc

SEQ ID NO: 207028 - DNA, 25 bp, E. coli
gttgccagtcaggaaaacgaagcgc

SEQ ID NO: 207029 - DNA, 25 bp, E. coli
tggcaaagttgccagtcagcaaaac

SEQ ID NO: 207030 - DNA, 25 bp, E. coli
ggcaaagttgccagtcagcaaaacg

SEQ ID NO: 207031 - DNA, 25 bp, E. coli
ggcaaagttgcctgtcagcaaaacg

SEQ ID NO: 207032 - DNA, 25 bp, E. coli
tggcaaagttgcgagtcagcaaaac

SEQ ID NO: 207033 - DNA, 25 bp, E. coli
caacgacgatgacttctacgaagca

SEQ ID NO: 207034 - DNA, 25 bp, E. coli
cacgttacaccaataaagatctggt

SEQ ID NO: 207035 - DNA, 25 bp, E. coli
cacgttacaccattaaagatctggt

SEQ ID NO: 207036 - DNA, 25 bp, E. coli
caacgacgatgagttctacgaagca

SEQ ID NO: 207037 - DNA, 25 bp, E. coli
taaatacgttgatattggtgcgacc

SEQ ID NO: 207038 - DNA, 25 bp, E. coli
taaatacgttgaaattggtgcgacc

SEQ ID NO: 207039 - DNA, 25 bp, E. coli
tatgaccccataaggtggtggcgag

SEQ ID NO: 207040 - DNA, 25 bp, E. coli
tagcagctatgtacgctgaaactcg

SEQ ID NO: 207041 - DNA, 25 bp, E. coli
tatgaccccatatggtggtggcgag

SEQ ID NO: 207042 - DNA, 25 bp, E. coli
tagcagctatgttcgctgaaactcg

SEQ ID NO: 207043 - DNA, 25 bp, E. coli
tgacttctacgaagcaaacggcatc

SEQ ID NO: 207044 - DNA, 25 bp, E. coli
tgacttctacgatgcaaacggcatc

SEQ ID NO: 207045 - DNA, 25 bp, E. coli
gctgaaactcgctatatgaccccat

SEQ ID NO: 207046 - DNA, 25 bp, E. coli
gctgaaactcgcaatatgaccccat

SEQ ID NO: 207047 - DNA, 25 bp, E. coli
ggtgaatcaagaacagccatcgcta

SEQ ID NO: 207048 - DNA, 25 bp, E. coli
ggtgaatcaagatcagccatcgcta

SEQ ID NO: 207049 - DNA, 25 bp, E. coli
ggcgacccacgttacaccaataaag

SEQ ID NO: 207050 - DNA, 25 bp, E. coli
tggcgagtttgataatggtgaatca

SEQ ID NO: 207051 - DNA, 25 bp, E. coli
ggctcatgacgggaacggcgaccca

SEQ ID NO: 207052 - DNA, 25 bp, E. coli
ggcgacccacgtaacaccaataaag

SEQ ID NO: 207053 - DNA, 25 bp, E. coli
ggctcatgacggcaacggcgaccca

SEQ ID NO: 207054 - DNA, 25 bp, E. coli
tggcgagtttgaaaatggtgaatca

SEQ ID NO: 207055 - DNA, 25 bp, E. coli
cactgaaagcgggtcgtgctgatta

SEQ ID NO: 207056 - DNA, 25 bp, E. coli
cactgaaagcggctcgtgctgatta

SEQ ID NO: 207057 - DNA, 25 bp, E. coli
cagtgaagagaaccctgtcggcacc

SEQ ID NO: 207058 - DNA, 25 bp, E. coli
cagtgaagagaagcctgtcggcacc

SEQ ID NO: 207059 - DNA, 25 bp, E. coli
caggctactgcgaatgcattgcaga

SEQ ID NO: 207060 - DNA, 25 bp, E. coli
caggctactgcgtatgcattgcaga

SEQ ID NO: 207061 - DNA, 25 bp, E. coli
tgatgcggtgcgacgtcaggctact

SEQ ID NO: 207062 - DNA, 25 bp, E. coli
tgtctattagtgctatcgccgggcc

SEQ ID NO: 207063 - DNA, 25 bp, E. coli
tgtctattagtggtatcgccgggcc

SEQ ID NO: 207064 - DNA, 25 bp, E. coli
tgatgcggtgcgtcgtcaggctact

SEQ ID NO: 207065 - DNA, 25 bp, E. coli
gcctggtttgaaggcggatttgtca

SEQ ID NO: 207066 - DNA, 25 bp, E. coli
gcctggtttgaacgcggatttgtca

SEQ ID NO: 207067 - DNA, 25 bp, E. coli
gcattgcagaccatgtggcaacaat

SEQ ID NO: 207068 - DNA, 25 bp, E. coli
gcgaaagtgattaccgatattgccg

SEQ ID NO: 207069 - DNA, 25 bp, E. coli
gcattgcagaccttgtggcaacaat

SEQ ID NO: 207070 - DNA, 25 bp, E. coli
gcgaaagtgatttccgatattgccg

SEQ ID NO: 207071 - DNA, 25 bp, E. coli
gcaccgtctggtttgcttttgccac

SEQ ID NO: 207072 - DNA, 25 bp, E. coli
gcaccgtctggtatgcttttgccac

SEQ ID NO: 207073 - DNA, 25 bp, E. coli
ctgaaagcccgtcgcgcaaccgtaa

SEQ ID NO: 207074 - DNA, 25 bp, E. coli
ctgaaagcccgtggcgcaaccgtaa

SEQ ID NO: 207075 - DNA, 25 bp, E. coli
ggatttgtcaccaacagtaacgaag

SEQ ID NO: 207076 - DNA, 25 bp, E. coli
ggatttgtcacctacagtaacgaag

SEQ ID NO: 207077 - DNA, 25 bp, E. coli
caaacagtggtggacgcgtcgtaac

SEQ ID NO: 207078 - DNA, 25 bp, E. coli
caacgaggtgaacatctgagggcta

SEQ ID NO: 207079 - DNA, 25 bp, E. coli
caaacagtggtgcacgcgtcgtaac

SEQ ID NO: 207080 - DNA, 25 bp, E. coli
caacgaggtgaagatctgagggcta

SEQ ID NO: 207081 - DNA, 25 bp, E. coli
catccggtttctgaacaagagggcc

SEQ ID NO: 207082 - DNA, 25 bp, E. coli
catccggtttctcaacaagagggcc

SEQ ID NO: 207083 - DNA, 25 bp, E. coli
tacgcgctcaagctaatcaggcagc

SEQ ID NO: 207084 - DNA, 25 bp, E. coli
tacgcgctcaaggtaatcaggcagc

SEQ ID NO: 207085 - DNA, 25 bp, E. coli
tatggagcttaagcggctatggctg

SEQ ID NO: 207086 - DNA, 25 bp, E. coli
tatggagcttaaccggctatggctg

SEQ ID NO: 207087 - DNA, 25 bp, E. coli
tatcacgagatttgcaggaatgcca

SEQ ID NO: 207088 - DNA, 25 bp, E. coli
tatcacgagattagcaggaatgcca

SEQ ID NO: 207089 - DNA, 25 bp, E. coli
tgccattaaacgtggcggacaacga

SEQ ID NO: 207090 - DNA, 25 bp, E. coli
tgccattaaacgaggcggacaacga

SEQ ID NO: 207091 - DNA, 25 bp, E. coli
tgactgtatgccgagaaactccgaa

SEQ ID NO: 207092 - DNA, 25 bp, E. coli
tgactgtatgcccagaaactccgaa

SEQ ID NO: 207093 - DNA, 25 bp, E. coli
gaatcaagggcaatcagttacgcgc

SEQ ID NO: 207094 - DNA, 25 bp, E. coli
gaatcaagggcattcagttacgcgc

SEQ ID NO: 207095 - DNA, 25 bp, E. coli
tacagtgggttcagtcgtttgcaga

SEQ ID NO: 207096 - DNA, 25 bp, E. coli
tacagtgggttctgtcgtttgcaga

SEQ ID NO: 207097 - DNA, 25 bp, E. coli
gagccagtgttcataagttccgaca

SEQ ID NO: 207098 - DNA, 25 bp, E. coli
gagccagtgttcttaagttccgaca

SEQ ID NO: 207099 - DNA, 25 bp, E. coli
aacgcgcaggcgttgctgccgtgct

SEQ ID NO: 207100 - DNA, 25 bp, E. coli
catcgggttttgagctccatcagca

SEQ ID NO: 207101 - DNA, 25 bp, E. coli
catcgggttttgtgctccatcagca

SEQ ID NO: 207102 - DNA, 25 bp, E. coli
agcatcaggtcaaagcccgacgcgt

SEQ ID NO: 207103 - DNA, 25 bp, E. coli
atagcccgacgcgtggcgaacactg

SEQ ID NO: 207104 - DNA, 25 bp, E. coli
atagcccgacgcctggcgaacactg

SEQ ID NO: 207105 - DNA, 25 bp, E. coli
agcatcaggtcatagcccgacgcgt

SEQ ID NO: 207106 - DNA, 25 bp, E. coli
aacgcgcaggcgatgctgccgtgct

SEQ ID NO: 207107 - DNA, 25 bp, E. coli
tattcttcttcatcgggttttgtgc

SEQ ID NO: 207108 - DNA, 25 bp, E. coli
tattcttcttcaacgggttttgtgc

SEQ ID NO: 207109 - DNA, 25 bp, E. coli
ttgcagcagcatcaggtcatagccc

SEQ ID NO: 207110 - DNA, 25 bp, E. coli
ttgtgctccatctgcaattggtcag

SEQ ID NO: 207111 - DNA, 25 bp, E. coli
ttgcagcagcatgaggtcatagccc

SEQ ID NO: 207112 - DNA, 25 bp, E. coli
ttgtgctccatcagcaattggtcag

SEQ ID NO: 207113 - DNA, 25 bp, E. coli
tgttcagcctgaacgcgcaggcgat

SEQ ID NO: 207114 - DNA, 25 bp, E. coli
tgttcagcctgatcgcgcaggcgat

SEQ ID NO: 207115 - DNA, 25 bp, E. coli
tcaggctcatggtttatgctccggc

SEQ ID NO: 207116 - DNA, 25 bp, E. coli
tcaggctcatggattatgctccggc

SEQ ID NO: 207117 - DNA, 25 bp, E. coli
gctgccgtgctggactcaggctcat

SEQ ID NO: 207118 - DNA, 25 bp, E. coli
gctgccgtgctgcactcaggctcat

SEQ ID NO: 207119 - DNA, 25 bp, E. coli
ggctcatggtttttgctccggcttc

SEQ ID NO: 207120 - DNA, 25 bp, E. coli
ggctcatggtttatgctccggcttc

SEQ ID NO: 207121 - DNA, 25 bp, E. coli
caagcattacctgaaaatttgaatt

SEQ ID NO: 207122 - DNA, 25 bp, E. coli
caacggcccgaagggtgaggagcga

SEQ ID NO: 207123 - DNA, 25 bp, E. coli
caacggcccgaacggtgaggagcga

SEQ ID NO: 207124 - DNA, 25 bp, E. coli
caagcattacctcaaaatttgaatt

SEQ ID NO: 207125 - DNA, 25 bp, E. coli
cagcgatgtggtaacttcggtgaga

SEQ ID NO: 207126 - DNA, 25 bp, E. coli
cagcgatgtggttacttcggtgaga

SEQ ID NO: 207127 - DNA, 25 bp, E. coli
attgtgaaagttagcactcatcggg

SEQ ID NO: 207128 - DNA, 25 bp, E. coli
aggagcgaagcgacgaataatcctt

SEQ ID NO: 207129 - DNA, 25 bp, E. coli
attgtgaaagtttgcactcatcggg

SEQ ID NO: 207130 - DNA, 25 bp, E. coli
aggagcgaagcgtcgaataatcctt

SEQ ID NO: 207131 - DNA, 25 bp, E. coli
cttcggtgagatagtgaaagtttgc

SEQ ID NO: 207132 - DNA, 25 bp, E. coli
cttcggtgagattgtgaaagtttgc

SEQ ID NO: 207133 - DNA, 25 bp, E. coli
gtgaggagcgaagcgacgaataatc

SEQ ID NO: 207134 - DNA, 25 bp, E. coli
ggtgagaaccttggactaaggttcg

SEQ ID NO: 207135 - DNA, 25 bp, E. coli
ggaagggtgagaaccttcgactaag

SEQ ID NO: 207136 - DNA, 25 bp, E. coli
ggtaacttcggtcagattgtgaaag

SEQ ID NO: 207137 - DNA, 25 bp, E. coli
ggtgagaaccttcgactaaggttcg

SEQ ID NO: 207138 - DNA, 25 bp, E. coli
gtgaggagcgaaccgacgaataatc

SEQ ID NO: 207139 - DNA, 25 bp, E. coli
ggtaacttcggtgagattgtgaaag

SEQ ID NO: 207140 - DNA, 25 bp, E. coli
ggaagggtgagatccttcgactaag

SEQ ID NO: 207141 - DNA, 25 bp, E. coli
tcaccacagcgatgtggtaacttcg

SEQ ID NO: 207142 - DNA, 25 bp, E. coli
tcaccacagcgaagtggtaacttcg

SEQ ID NO: 207143 - DNA, 25 bp, E. coli
cagaggcaccagcacggtacaatac

SEQ ID NO: 207144 - DNA, 25 bp, E. coli
cagaggcaccaggacggtacaatac

SEQ ID NO: 207145 - DNA, 25 bp, E. coli
tactcagcggatttggcgttttgat

SEQ ID NO: 207146 - DNA, 25 bp, E. coli
tactcagcggatatggcgttttgat

SEQ ID NO: 207147 - DNA, 25 bp, E. coli
tatggataggattattactcagcgg

SEQ ID NO: 207148 - DNA, 25 bp, E. coli
tatggcgttttgattggaagcaaag

SEQ ID NO: 207149 - DNA, 25 bp, E. coli
tatggcgttttgtttggaagcaaag

SEQ ID NO: 207150 - DNA, 25 bp, E. coli
tatggataggataattactcagcgg

SEQ ID NO: 207151 - DNA, 25 bp, E. coli
taggattattacacagcggatatgg

SEQ ID NO: 207152 - DNA, 25 bp, E. coli
taggattattactcagcggatatgg

SEQ ID NO: 207153 - DNA, 25 bp, E. coli
tattactcagcggatatggcgtttt

SEQ ID NO: 207154 - DNA, 25 bp, E. coli
tattactcagcgcatatggcgtttt

SEQ ID NO: 207155 - DNA, 25 bp, E. coli
tgattggaagcaaagagaatgccgc

SEQ ID NO: 207156 - DNA, 25 bp, E. coli
tgattggaagcatagagaatgccgc

SEQ ID NO: 207157 - DNA, 25 bp, E. coli
gccagaggcacctgcacggtacaat

SEQ ID NO: 207158 - DNA, 25 bp, E. coli
gccagaggcaccagcacggtacaat

SEQ ID NO: 207159 - DNA, 25 bp, E. coli
cggatatggcgtattgattggaagc

SEQ ID NO: 207160 - DNA, 25 bp, E. coli
cggatatggcgttttgattggaagc

SEQ ID NO: 207161 - DNA, 25 bp, E. coli
gattattactcagcggatatggcgt

SEQ ID NO: 207162 - DNA, 25 bp, E. coli
gattattactcaccggatatggcgt

SEQ ID NO: 207163 - DNA, 25 bp, E. coli
ggataggattattactcagcggata

SEQ ID NO: 207164 - DNA, 25 bp, E. coli
ggataggattataactcagcggata

SEQ ID NO: 207165 - DNA, 25 bp, E. coli
aagtcagtgagcagaagcaggcgac

SEQ ID NO: 207166 - DNA, 25 bp, E. coli
aagtcagtgagctgaagcaggcgac

SEQ ID NO: 207167 - DNA, 25 bp, E. coli
catcgcctataatgaacagcgtgat

SEQ ID NO: 207168 - DNA, 25 bp, E. coli
catcgcctataaagaacagcgtgat

SEQ ID NO: 207169 - DNA, 25 bp, E. coli
taaagaacagcgtgataaaaaagtc

SEQ ID NO: 207170 - DNA, 25 bp, E. coli
taaagaacagcgagataaaaaagtc

SEQ ID NO: 207171 - DNA, 25 bp, E. coli
agcgtgctgctgatgcactcgatgc

SEQ ID NO: 207172 - DNA, 25 bp, E. coli
agcgtgctgctgttgcactcgatgc

SEQ ID NO: 207173 - DNA, 25 bp, E. coli
tgaagcaggcgagcgccaccattac

SEQ ID NO: 207174 - DNA, 25 bp, E. coli
tgaagcaggcgaccgccaccattac

SEQ ID NO: 207175 - DNA, 25 bp, E. coli
tcagtgagctgatgcaggcgaccgc

SEQ ID NO: 207176 - DNA, 25 bp, E. coli
tcagtgagctgaagcaggcgaccgc

SEQ ID NO: 207177 - DNA, 25 bp, E. coli
gccagcgtgctgctgatgcactcga

SEQ ID NO: 207178 - DNA, 25 bp, E. coli
gccagcgtgctggtgatgcactcga

SEQ ID NO: 207179 - DNA, 25 bp, E. coli
gctgctgatgcagtcgatgctaaat

SEQ ID NO: 207180 - DNA, 25 bp, E. coli
gctgctgatgcactcgatgctaaat

SEQ ID NO: 207181 - DNA, 25 bp, E. coli
gcagcgccagcgagctgctgatgca

SEQ ID NO: 207182 - DNA, 25 bp, E. coli
gcagcgccagcgtgctgctgatgca

SEQ ID NO: 207183 - DNA, 25 bp, E. coli
cgcctataaagaacagcgtgataaa

SEQ ID NO: 207184 - DNA, 25 bp, E. coli
cgcctataaagatcagcgtgataaa

SEQ ID NO: 207185 - DNA, 25 bp, E. coli
ctgatgcactcgttgctaaatacac

SEQ ID NO: 207186 - DNA, 25 bp, E. coli
ctgatgcactcgatgctaaatacac

SEQ ID NO: 207187 - DNA, 25 bp, E. coli
caaacatttgctctgggcggtgacg

SEQ ID NO: 207188 - DNA, 25 bp, E. coli
caaacatttgctgtgggcggtgacg

SEQ ID NO: 207189 - DNA, 25 bp, E. coli
catgcactgcacgtttatttgtgac

SEQ ID NO: 207190 - DNA, 25 bp, E. coli
catgcactgcacctttatttgtgac

SEQ ID NO: 207191 - DNA, 25 bp, E. coli
acgaaaccctcgaagggcaggcgcg

SEQ ID NO: 207192 - DNA, 25 bp, E. coli
acgaaaccctcgtagggcaggcgcg

SEQ ID NO: 207193 - DNA, 25 bp, E. coli
acaggcgacggcaatctactgcggg

SEQ ID NO: 207194 - DNA, 25 bp, E. coli
acaggcgacggctatctactgcggg

SEQ ID NO: 207195 - DNA, 25 bp, E. coli
tatttgtgacgaggaaaccctcgaa

SEQ ID NO: 207196 - DNA, 25 bp, E. coli
tttgatgtgctgacgcagccgctac

SEQ ID NO: 207197 - DNA, 25 bp, E. coli
tttgatgtgctgtcgcagccgctac

SEQ ID NO: 207198 - DNA, 25 bp, E. coli
tatttgtgacgacgaaaccctcgaa

SEQ ID NO: 207199 - DNA, 25 bp, E. coli
tgcagtggtacaccattcctccgct

SEQ ID NO: 207200 - DNA, 25 bp, E. coli
tgcagtggtacagcattcctccgct

SEQ ID NO: 207201 - DNA, 25 bp, E. coli
tcattcccatgcgaataaacggatg

SEQ ID NO: 207202 - DNA, 25 bp, E. coli
tcattcccatgccaataaacggatg

SEQ ID NO: 207203 - DNA, 25 bp, E. coli
tctactgcgggctgaactggctgcc

SEQ ID NO: 207204 - DNA, 25 bp, E. coli
tctactgcgggcagaactggctgcc

SEQ ID NO: 207205 - DNA, 25 bp, E. coli
gaaattcgctctctttatcaactct

SEQ ID NO: 207206 - DNA, 25 bp, E. coli
gaaattcgctctgtttatcaactct

SEQ ID NO: 207207 - DNA, 25 bp, E. coli
cgctggaaggcgacgaaattcgctc

SEQ ID NO: 207208 - DNA, 25 bp, E. coli
cgctggaaggcgtcgaaattcgctc

SEQ ID NO: 207209 - DNA, 25 bp, E. coli
aaggaactggatccgctctatgagc

SEQ ID NO: 207210 - DNA, 25 bp, E. coli
aaggaactggatgcgctctatgagc

SEQ ID NO: 207211 - DNA, 25 bp, E. coli
agttgattgtgctggccgtaacgcc

SEQ ID NO: 207212 - DNA, 25 bp, E. coli
agttgattgtgcaggccgtaacgcc

SEQ ID NO: 207213 - DNA, 25 bp, E. coli
gaaaccagttcgctacatttaggct

SEQ ID NO: 207214 - DNA, 25 bp, E. coli
aacatctggatgtcagcgcgctgga

SEQ ID NO: 207215 - DNA, 25 bp, E. coli
aacatctggatgacagcgcgctgga

SEQ ID NO: 207216 - DNA, 25 bp, E. coli
gaaaccagttcggtacatttaggct

SEQ ID NO: 207217 - DNA, 25 bp, E. coli
ttaagctgtatctggcgcggatgcc

SEQ ID NO: 207218 - DNA, 25 bp, E. coli
ttaagctgtatcaggcgcggatgcc

SEQ ID NO: 207219 - DNA, 25 bp, E. coli
ttggcgacgccaaggaacagatgat

SEQ ID NO: 207220 - DNA, 25 bp, E. coli
tttcctcggacgcaaacagtcacgc

SEQ ID NO: 207221 - DNA, 25 bp, E. coli
ttggcgacgccatggaacagatgat

SEQ ID NO: 207222 - DNA, 25 bp, E. coli
tttcctcggacggaaacagtcacgc

SEQ ID NO: 207223 - DNA, 25 bp, E. coli
tggtgggtagccagattatcctgcc

SEQ ID NO: 207224 - DNA, 25 bp, E. coli
tgcgtactgtccatagccggagcgt

SEQ ID NO: 207225 - DNA, 25 bp, E. coli
tgcgtactgtccttagccggagcgt

SEQ ID NO: 207226 - DNA, 25 bp, E. coli
gaactggatacccagctacggccta

SEQ ID NO: 207227 - DNA, 25 bp, E. coli
gaactggataccgagctacggccta

SEQ ID NO: 207228 - DNA, 25 bp, E. coli
gattattcgcgaagaaccggaactg

SEQ ID NO: 207229 - DNA, 25 bp, E. coli
gattattcgcgatgaaccggaactg

SEQ ID NO: 207230 - DNA, 25 bp, E. coli
tggtgggtagcctgattatcctgcc

SEQ ID NO: 207231 - DNA, 25 bp, E. coli
caagtttcggcagataagccggact

SEQ ID NO: 207232 - DNA, 25 bp, E. coli
caagtttcggcacataagccggact

SEQ ID NO: 207233 - DNA, 25 bp, E. coli
aaccggagactctgcccggcgcagt

SEQ ID NO: 207234 - DNA, 25 bp, E. coli
aaccggagactcagcccggcgcagt

SEQ ID NO: 207235 - DNA, 25 bp, E. coli
tagcgctcggctctggcgtagcctt

SEQ ID NO: 207236 - DNA, 25 bp, E. coli
tagcgctcggctgtggcgtagcctt

SEQ ID NO: 207237 - DNA, 25 bp, E. coli
gcgacaaatacagcgcctggaagaa

SEQ ID NO: 207238 - DNA, 25 bp, E. coli
gcgacaaatacaccgcctggaagaa

SEQ ID NO: 207239 - DNA, 25 bp, E. coli
gctttcgcgacaaatacagcgcctg

SEQ ID NO: 207240 - DNA, 25 bp, E. coli
gctttcgcgacatatacagcgcctg

SEQ ID NO: 207241 - DNA, 25 bp, E. coli
cgttagcccgtcaacgctttcgcga

SEQ ID NO: 207242 - DNA, 25 bp, E. coli
cgttagcccgtctacgctttcgcga

SEQ ID NO: 207243 - DNA, 25 bp, E. coli
gtctacagtgccgtttatcatggcc

SEQ ID NO: 207244 - DNA, 25 bp, E. coli
gtctacagtgccctttatcatggcc

SEQ ID NO: 207245 - DNA, 25 bp, E. coli
tgcccggtgcgttaccaagtttcgg

SEQ ID NO: 207246 - DNA, 25 bp, E. coli
ggcaatgcacgttagcccgtctacg

SEQ ID NO: 207247 - DNA, 25 bp, E. coli
ggcaatgcacgtaagcccgtctacg

SEQ ID NO: 207248 - DNA, 25 bp, E. coli
tgcccggtgcgtaaccaagtttcgg

SEQ ID NO: 207249 - DNA, 25 bp, E. coli
taagggctgcgccattggatttacg

SEQ ID NO: 207250 - DNA, 25 bp, E. coli
taagccggactgctctacagtgccg

SEQ ID NO: 207251 - DNA, 25 bp, E. coli
taagggctgcgcgattggatttacg

SEQ ID NO: 207252 - DNA, 25 bp, E. coli
taagccggactggtctacagtgccg

SEQ ID NO: 207253 - DNA, 25 bp, E. coli
tactatcgtcggcacggcgtttgcc

SEQ ID NO: 207254 - DNA, 25 bp, E. coli
tactatcgtcgggacggcgtttgcc

SEQ ID NO: 207255 - DNA, 25 bp, E. coli
actactggcgtgaaacccgatgtcg

SEQ ID NO: 207256 - DNA, 25 bp, E. coli
actactggcgtgtaacccgatgtcg

SEQ ID NO: 207257 - DNA, 25 bp, E. coli
tcgctggcctggatatgtttaacgg

SEQ ID NO: 207258 - DNA, 25 bp, E. coli
tcgctggcctggttatgtttaacgg

SEQ ID NO: 207259 - DNA, 25 bp, E. coli
tcggcacggcgtatgccattactac

SEQ ID NO: 207260 - DNA, 25 bp, E. coli
tcggcacggcgtttgccattactac

SEQ ID NO: 207261 - DNA, 25 bp, E. coli
gcgtttgccattactactggcgtga

SEQ ID NO: 207262 - DNA, 25 bp, E. coli
gcgtttgccatttctactggcgtga

SEQ ID NO: 207263 - DNA, 25 bp, E. coli
ccggcggtacgctggaactggtgtg

SEQ ID NO: 207264 - DNA, 25 bp, E. coli
cgccgtacctttcgctgtcgcagta

SEQ ID NO: 207265 - DNA, 25 bp, E. coli
cgccgtacctttggctgtcgcagta

SEQ ID NO: 207266 - DNA, 25 bp, E. coli
ccggcggtacgcaggaactggtgtg

SEQ ID NO: 207267 - DNA, 25 bp, E. coli
ctttcgctgtcggagtacagatggg

SEQ ID NO: 207268 - DNA, 25 bp, E. coli
ctttcgctgtcgcagtacagatggg

SEQ ID NO: 207269 - DNA, 25 bp, E. coli
gattatcggtactatcgtcggcacg

SEQ ID NO: 207270 - DNA, 25 bp, E. coli
gattatcggtacaatcgtcggcacg

SEQ ID NO: 207271 - DNA, 25 bp, E. coli
gggattaccttcctgttctcggtga

SEQ ID NO: 207272 - DNA, 25 bp, E. coli
gggattaccttcgtgttctcggtga

SEQ ID NO: 207273 - DNA, 25 bp, E. coli
tggtacttggcgttctgcataccgg

SEQ ID NO: 207274 - DNA, 25 bp, E. coli
tggtacttggcgatctgcataccgg

SEQ ID NO: 207275 - DNA, 25 bp, E. coli
cagtagaagaggttattgattcccc

SEQ ID NO: 207276 - DNA, 25 bp, E. coli
cagtagaagaggatattgattcccc

SEQ ID NO: 207277 - DNA, 25 bp, E. coli
tacacggcgaccatggaatggtggc

SEQ ID NO: 207278 - DNA, 25 bp, E. coli
tacacggcgaccttggaatggtggc

SEQ ID NO: 207279 - DNA, 25 bp, E. coli
tattattgccagaaaactcgcagca

SEQ ID NO: 207280 - DNA, 25 bp, E. coli
tatttcaaacagtggtgagacggcg

SEQ ID NO: 207281 - DNA, 25 bp, E. coli
tatcatccaggaggtgcactcggca

SEQ ID NO: 207282 - DNA, 25 bp, E. coli
tatcatccaggacgtgcactcggca

SEQ ID NO: 207283 - DNA, 25 bp, E. coli
tattattgccagtaaactcgcagca

SEQ ID NO: 207284 - DNA, 25 bp, E. coli
tatttcaaacagaggtgagacggcg

SEQ ID NO: 207285 - DNA, 25 bp, E. coli
tgaaatccccgtgaaaagtgaggcg

SEQ ID NO: 207286 - DNA, 25 bp, E. coli
tgaaatccccgtcaaaagtgaggcg

SEQ ID NO: 207287 - DNA, 25 bp, E. coli
tcacggtacggaagcggtacacggc

SEQ ID NO: 207288 - DNA, 25 bp, E. coli
tcacggtacggatgcggtacacggc

SEQ ID NO: 207289 - DNA, 25 bp, E. coli
gcaacttttgccagtaccggaactc

SEQ ID NO: 207290 - DNA, 25 bp, E. coli
gcaacttttgcctgtaccggaactc

SEQ ID NO: 207291 - DNA, 25 bp, E. coli
ggtttagcaccgacatgctcgtcga

SEQ ID NO: 207292 - DNA, 25 bp, E. coli
ggaaatcctggcgacactgcctagt

SEQ ID NO: 207293 - DNA, 25 bp, E. coli
ggtttagcaccgtcatgctcgtcga

SEQ ID NO: 207294 - DNA, 25 bp, E. coli
ggaaatcctggccacactgcctagt

SEQ ID NO: 207295 - DNA, 25 bp, E. coli
tggcgcttgcacactctgaattgaa

SEQ ID NO: 207296 - DNA, 25 bp, E. coli
tggcgcttgcactctctgaattgaa

SEQ ID NO: 207297 - DNA, 25 bp, E. coli
aaaaaggctcgtgagcgatttactg

SEQ ID NO: 207298 - DNA, 25 bp, E. coli
aaaaaggctcgtcagcgatttactg

SEQ ID NO: 207299 - DNA, 25 bp, E. coli
tatccctggcagtgaaataattacg

SEQ ID NO: 207300 - DNA, 25 bp, E. coli
tatccctggcagagaaataattacg

SEQ ID NO: 207301 - DNA, 25 bp, E. coli
ttgctggagagtaaaaaaaggctcg

SEQ ID NO: 207302 - DNA, 25 bp, E. coli
ttgctggagagttaaaaaaggctcg

SEQ ID NO: 207303 - DNA, 25 bp, E. coli
tgcaagcgaagatatattaccttga

SEQ ID NO: 207304 - DNA, 25 bp, E. coli
tgcaagcgaagaaatattaccttga

SEQ ID NO: 207305 - DNA, 25 bp, E. coli
tcgtcagcgatttactggaatccat

SEQ ID NO: 207306 - DNA, 25 bp, E. coli
tcgtcagcgattaactggaatccat

SEQ ID NO: 207307 - DNA, 25 bp, E. coli
tcagcgatttactggaatccattga

SEQ ID NO: 207308 - DNA, 25 bp, E. coli
tcagcgatttacaggaatccattga

SEQ ID NO: 207309 - DNA, 25 bp, E. coli
gcctgcaagcgatgatatattacct

SEQ ID NO: 207310 - DNA, 25 bp, E. coli
gcctgcaagcgaagatatattacct

SEQ ID NO: 207311 - DNA, 25 bp, E. coli
ccctggcagtgatataattacgatc

SEQ ID NO: 207312 - DNA, 25 bp, E. coli
ccctggcagtgaaataattacgatc

SEQ ID NO: 207313 - DNA, 25 bp, E. coli
gttcaagcctgctagcgaagatata

SEQ ID NO: 207314 - DNA, 25 bp, E. coli
gttcaagcctgcaagcgaagatata

SEQ ID NO: 207315 - DNA, 25 bp, E. coli
ggctcgtcagcgatttactggaatc

SEQ ID NO: 207316 - DNA, 25 bp, E. coli
tggcagtgaaataattacgatcatg

SEQ ID NO: 207317 - DNA, 25 bp, E. coli
tggcagtgaaattattacgatcatg

SEQ ID NO: 207318 - DNA, 25 bp, E. coli
ggctcgtcagcgttttactggaatc

SEQ ID NO: 207319 - DNA, 25 bp, E. coli
tacatcctgaaagatgcgtcgacag

SEQ ID NO: 207320 - DNA, 25 bp, E. coli
tacatcctgaaacatgcgtcgacag

SEQ ID NO: 207321 - DNA, 25 bp, E. coli
taccctgtcattaacatgagcaccg

SEQ ID NO: 207322 - DNA, 25 bp, E. coli
taccctgtcatttacatgagcaccg

SEQ ID NO: 207323 - DNA, 25 bp, E. coli
tatactcgacctagcaaacactttg

SEQ ID NO: 207324 - DNA, 25 bp, E. coli
tatactcgaccttgcaaacactttg

SEQ ID NO: 207325 - DNA, 25 bp, E. coli
tgtcatcagtctcgaagccgcacgt

SEQ ID NO: 207326 - DNA, 25 bp, E. coli
tgtcatcagtctggaagccgcacgt

SEQ ID NO: 207327 - DNA, 25 bp, E. coli
tcgacagaacgcaccagggatgtgc

SEQ ID NO: 207328 - DNA, 25 bp, E. coli
tcgacagaacgctccagggatgtgc

SEQ ID NO: 207329 - DNA, 25 bp, E. coli
gaagctgtaactttccttatactcg

SEQ ID NO: 207330 - DNA, 25 bp, E. coli
gaagctgtaactatccttatactcg

SEQ ID NO: 207331 - DNA, 25 bp, E. coli
tccagcatttttggcttcccgaagc

SEQ ID NO: 207332 - DNA, 25 bp, E. coli
tccagcatttttcgcttcccgaagc

SEQ ID NO: 207333 - DNA, 25 bp, E. coli
gactgaccgagtccttttttgatgt

SEQ ID NO: 207334 - DNA, 25 bp, E. coli
gactgaccgagtgcttttttgatgt

SEQ ID NO: 207335 - DNA, 25 bp, E. coli
taatttttcgcagcgatgctggcct

SEQ ID NO: 207336 - DNA, 25 bp, E. coli
taatctgcctaacccgtgtaccctg

SEQ ID NO: 207337 - DNA, 25 bp, E. coli
taatttttcgcaccgatgctggcct

SEQ ID NO: 207338 - DNA, 25 bp, E. coli
taatctgcctaagccgtgtaccctg

SEQ ID NO: 207339 - DNA, 25 bp, E. coli
gatgtgcgacaagacaatgaaagga

SEQ ID NO: 207340 - DNA, 25 bp, E. coli
gatgtgcgacaacacaatgaaagga

SEQ ID NO: 207341 - DNA, 25 bp, E. coli
cagactaattgatcgtgaagtgtgc

SEQ ID NO: 207342 - DNA, 25 bp, E. coli
cagactaattgaacgtgaagtgtgc

SEQ ID NO: 207343 - DNA, 25 bp, E. coli
tgcattactactttctgtcagacct

SEQ ID NO: 207344 - DNA, 25 bp, E. coli
tgcattactactatctgtcagacct

SEQ ID NO: 207345 - DNA, 25 bp, E. coli
tgaagtgtgcaatcgataaaagtgt

SEQ ID NO: 207346 - DNA, 25 bp, E. coli
tgaagtgtgcaaacgataaaagtgt

SEQ ID NO: 207347 - DNA, 25 bp, E. coli
tcggtgagacgctccctcaaaattt

SEQ ID NO: 207348 - DNA, 25 bp, E. coli
tcggtgagacgcaccctcaaaattt

SEQ ID NO: 207349 - DNA, 25 bp, E. coli
tccgcgtctcatgtttatcggtgag

SEQ ID NO: 207350 - DNA, 25 bp, E. coli
tccgcgtctcatctttatcggtgag

SEQ ID NO: 207351 - DNA, 25 bp, E. coli
tcttcgaagcactcgtaagaggcgt

SEQ ID NO: 207352 - DNA, 25 bp, E. coli
tcttcgaagcacacgtaagaggcgt

SEQ ID NO: 207353 - DNA, 25 bp, E. coli
gccacgcagcgaggatgagcgataa

SEQ ID NO: 207354 - DNA, 25 bp, E. coli
gccacgcagcgacgatgagcgataa

SEQ ID NO: 207355 - DNA, 25 bp, E. coli
gaaagtaatatgagcgccacgcagc

SEQ ID NO: 207356 - DNA, 25 bp, E. coli
gaaagtaatatgtgcgccacgcagc

SEQ ID NO: 207357 - DNA, 25 bp, E. coli
cccgttcattcaacttaagtctcca

SEQ ID NO: 207358 - DNA, 25 bp, E. coli
cccgttcattcatcttaagtctcca

SEQ ID NO: 207359 - DNA, 25 bp, E. coli
gacctccattctactgttgataaaa

SEQ ID NO: 207360 - DNA, 25 bp, E. coli
gagcgataaacaagttcttcgaagc

SEQ ID NO: 207361 - DNA, 25 bp, E. coli
gacctccattcttctgttgataaaa

SEQ ID NO: 207362 - DNA, 25 bp, E. coli
gagcgataaacatgttcttcgaagc

SEQ ID NO: 207363 - DNA, 25 bp, E. coli
aaatacgtagtcattcgtgagggcg

SEQ ID NO: 207364 - DNA, 25 bp, E. coli
aaatacgtagtctttcgtgagggcg

SEQ ID NO: 207365 - DNA, 25 bp, E. coli
tttaccagcaaataggaagccgatg

SEQ ID NO: 207366 - DNA, 25 bp, E. coli
tttaccagcaaaaaggaagccgatg

SEQ ID NO: 207367 - DNA, 25 bp, E. coli
tgagcaccattctgaaaaccggcaa

SEQ ID NO: 207368 - DNA, 25 bp, E. coli
tgagcaccattcagaaaaccggcaa

SEQ ID NO: 207369 - DNA, 25 bp, E. coli
tgctgaatccgatgaggaagatgcc

SEQ ID NO: 207370 - DNA, 25 bp, E. coli
tgctgaatccgaagaggaagatgcc

SEQ ID NO: 207371 - DNA, 25 bp, E. coli
tctccagtgcaaatggaagacgagc

SEQ ID NO: 207372 - DNA, 25 bp, E. coli
tctccagtgcaattggaagacgagc

SEQ ID NO: 207373 - DNA, 25 bp, E. coli
gaagagaaaatgtcgtttaccagca

SEQ ID NO: 207374 - DNA, 25 bp, E. coli
gaagagaaaatgacgtttaccagca

SEQ ID NO: 207375 - DNA, 25 bp, E. coli
gaacaaaaagatctgctgagcacca

SEQ ID NO: 207376 - DNA, 25 bp, E. coli
gaacaaaaagatgtgctgagcacca

SEQ ID NO: 207377 - DNA, 25 bp, E. coli
cccacaggtcgtcggtgctgaatcc

SEQ ID NO: 207378 - DNA, 25 bp, E. coli
cccacaggtcgtgggtgctgaatcc

SEQ ID NO: 207379 - DNA, 25 bp, E. coli
cgtgaagccctttcgctatggctgg

SEQ ID NO: 207380 - DNA, 25 bp, E. coli
cgtgaagcccttacgctatggctgg

SEQ ID NO: 207381 - DNA, 25 bp, E. coli
tggaagacgagctacgtgaagccct

SEQ ID NO: 207382 - DNA, 25 bp, E. coli
tggaagacgagcaacgtgaagccct

SEQ ID NO: 207383 - DNA, 25 bp, E. coli
gatctgcttgacacctggctgacaa

SEQ ID NO: 207384 - DNA, 25 bp, E. coli
gatctgcttgactcctggctgacaa

SEQ ID NO: 207385 - DNA, 25 bp, E. coli
acttcgccgcgggtggatttagccg

SEQ ID NO: 207386 - DNA, 25 bp, E. coli
acttcgccgcggctggatttagccg

SEQ ID NO: 207387 - DNA, 25 bp, E. coli
tgccgccagcagttttagtttcaac

SEQ ID NO: 207388 - DNA, 25 bp, E. coli
tgccgccagcagatttagtttcaac

SEQ ID NO: 207389 - DNA, 25 bp, E. coli
tctttacgcttgacgatcacgcgat

SEQ ID NO: 207390 - DNA, 25 bp, E. coli
tctttacgcttgtcgatcacgcgat

SEQ ID NO: 207391 - DNA, 25 bp, E. coli
gctttcggacatgatcaacacttct

SEQ ID NO: 207392 - DNA, 25 bp, E. coli
gcggcttcacttcgccattttcaag

SEQ ID NO: 207393 - DNA, 25 bp, E. coli
gctttcggacatcatcaacacttct

SEQ ID NO: 207394 - DNA, 25 bp, E. coli
gcttcaacaattgccagaatgtcgc

SEQ ID NO: 207395 - DNA, 25 bp, E. coli
gcggcttcacttggccattttcaag

SEQ ID NO: 207396 - DNA, 25 bp, E. coli
gcttcaacaattcccagaatgtcgc

SEQ ID NO: 207397 - DNA, 25 bp, E. coli
cgttgaaaataaggatgtcgccaac

SEQ ID NO: 207398 - DNA, 25 bp, E. coli
cgttgaaaataacgatgtcgccaac

SEQ ID NO: 207399 - DNA, 25 bp, E. coli
ctgcagagccggacagaacgatgcc

SEQ ID NO: 207400 - DNA, 25 bp, E. coli
cattttcaaggatacggccattgcc

SEQ ID NO: 207401 - DNA, 25 bp, E. coli
cattttcaaggaaacggccattgcc

SEQ ID NO: 207402 - DNA, 25 bp, E. coli
ctgcagagccggtcagaacgatgcc

SEQ ID NO: 207403 - DNA, 25 bp, E. coli
gatttcacaccgaagccatcgttga

SEQ ID NO: 207404 - DNA, 25 bp, E. coli
gatttcacaccgtagccatcgttga

SEQ ID NO: 207405 - DNA, 25 bp, E. coli
tcacgcgatcatgcaatggacgaat

SEQ ID NO: 207406 - DNA, 25 bp, E. coli
tcacgcgatcatccaatggacgaat

SEQ ID NO: 207407 - DNA, 25 bp, E. coli
tatgttggcgtaacgaagccctgga

SEQ ID NO: 207408 - DNA, 25 bp, E. coli
tatgttggcgtatcgaagccctgga

SEQ ID NO: 207409 - DNA, 25 bp, E. coli
tatatctgcagcatgaagcatgggc

SEQ ID NO: 207410 - DNA, 25 bp, E. coli
tattactgaagtggctgtctctggg

SEQ ID NO: 207411 - DNA, 25 bp, E. coli
tatatctgcagcttgaagcatgggc

SEQ ID NO: 207412 - DNA, 25 bp, E. coli
tattactgaagtcgctgtctctggg

SEQ ID NO: 207413 - DNA, 25 bp, E. coli
tgttatgcataacccggaccttgcg

SEQ ID NO: 207414 - DNA, 25 bp, E. coli
tgttatgcataagccggaccttgcg

SEQ ID NO: 207415 - DNA, 25 bp, E. coli
tgctatgctggctagtgacccgcag

SEQ ID NO: 207416 - DNA, 25 bp, E. coli
tgctatgctggcaagtgacccgcag

SEQ ID NO: 207417 - DNA, 25 bp, E. coli
tgcaggaaaaacgagcgaagcgtct

SEQ ID NO: 207418 - DNA, 25 bp, E. coli
tgcaggaaaaaccagcgaagcgtct

SEQ ID NO: 207419 - DNA, 25 bp, E. coli
tccagccacgaatgaaaagcagtat

SEQ ID NO: 207420 - DNA, 25 bp, E. coli
tccagccacgaaagaaaagcagtat

SEQ ID NO: 207421 - DNA, 25 bp, E. coli
tcttccccagccagaaacagtggtc

SEQ ID NO: 207422 - DNA, 25 bp, E. coli
tcttccccagcctgaaacagtggtc

SEQ ID NO: 207423 - DNA, 25 bp, E. coli
gccctggaacgagtggacgaattat

SEQ ID NO: 207424 - DNA, 25 bp, E. coli
gccctggaacgactggacgaattat

SEQ ID NO: 207425 - DNA, 25 bp, E. coli
gcgtctggctattgagggacttcca

SEQ ID NO: 207426 - DNA, 25 bp, E. coli
gcgtctggctatagagggacttcca

SEQ ID NO: 207427 - DNA, 25 bp, E. coli
tcaacgccggtgaagtatatctgca

SEQ ID NO: 207428 - DNA, 25 bp, E. coli
tcaacgccggtgtagtatatctgca

SEQ ID NO: 207429 - DNA, 25 bp, E. coli
aacctgccctctattggtgtctcga

SEQ ID NO: 207430 - DNA, 25 bp, E. coli
aacctgccctcttttggtgtctcga

SEQ ID NO: 207431 - DNA, 25 bp, E. coli
caccgtactgattcgtctggcgacg

SEQ ID NO: 207432 - DNA, 25 bp, E. coli
caccgtactgatacgtctggcgacg

SEQ ID NO: 207433 - DNA, 25 bp, E. coli
acagggtgtggtttcagcgatgacc

SEQ ID NO: 207434 - DNA, 25 bp, E. coli
acagggtgtggtatcagcgatgacc

SEQ ID NO: 207435 - DNA, 25 bp, E. coli
actattcccagcgtaatctgtgcgg

SEQ ID NO: 207436 - DNA, 25 bp, E. coli
actattcccagcctaatctgtgcgg

SEQ ID NO: 207437 - DNA, 25 bp, E. coli
tatggcgtcctggtgactattccca

SEQ ID NO: 207438 - DNA, 25 bp, E. coli
tatggcgtcctgctgactattccca

SEQ ID NO: 207439 - DNA, 25 bp, E. coli
ttgagcgcccgacaccgtcatttct

SEQ ID NO: 207440 - DNA, 25 bp, E. coli
ttgagcgcccgagaccgtcatttct

SEQ ID NO: 207441 - DNA, 25 bp, E. coli
gctggtgatcgtaattgccgccgaa

SEQ ID NO: 207442 - DNA, 25 bp, E. coli
gctggtgatcgttattgccgccgaa

SEQ ID NO: 207443 - DNA, 25 bp, E. coli
gaagtggccttttttatgctggcgc

SEQ ID NO: 207444 - DNA, 25 bp, E. coli
gaagtggcctttattatgctggcgc

SEQ ID NO: 207445 - DNA, 25 bp, E. coli
gaaactggctattccggcagtagcg

SEQ ID NO: 207446 - DNA, 25 bp, E. coli
gaaactggctataccggcagtagcg

SEQ ID NO: 207447 - DNA, 25 bp, E. coli
gtcatttctgaaagcggatcaaccg

SEQ ID NO: 207448 - DNA, 25 bp, E. coli
gtcatttctgaatgcggatcaaccg

SEQ ID NO: 207449 - DNA, 25 bp, E. coli
taatctgtgcgggactgatcttgcc

SEQ ID NO: 207450 - DNA, 25 bp, E. coli
taatctgtgcggcactgatcttgcc

SEQ ID NO: 207451 - DNA, 25 bp, E. coli
catattgcaaggtaatgtaggcctg

SEQ ID NO: 207452 - DNA, 25 bp, E. coli
catattgcaaggaaatgtaggcctg

SEQ ID NO: 207453 - DNA, 25 bp, E. coli
ttcactattgctcgcaaattgcgct

SEQ ID NO: 207454 - DNA, 25 bp, E. coli
ttcactattgctggcaaattgcgct

SEQ ID NO: 207455 - DNA, 25 bp, E. coli
tgaaaatttattttgcgtcgaacgt

SEQ ID NO: 207456 - DNA, 25 bp, E. coli
tgaaaatttattatgcgtcgaacgt

SEQ ID NO: 207457 - DNA, 25 bp, E. coli
tgcgtcgaacgtatatcaaaaaaga

SEQ ID NO: 207458 - DNA, 25 bp, E. coli
tgcgtcgaacgtttatcaaaaaaga

SEQ ID NO: 207459 - DNA, 25 bp, E. coli
tcaaaaaagaaaggcgtcgtcatca

SEQ ID NO: 207460 - DNA, 25 bp, E. coli
tcaaaaaagaaacgcgtcgtcatca

SEQ ID NO: 207461 - DNA, 25 bp, E. coli
gccgtttccacaactcgctgttgcg

SEQ ID NO: 207462 - DNA, 25 bp, E. coli
gccgtttccacatctcgctgttgcg

SEQ ID NO: 207463 - DNA, 25 bp, E. coli
gcttttatcatctctctgaaacggg

SEQ ID NO: 207464 - DNA, 25 bp, E. coli
gtcatcacgacggtggcccgttatt

SEQ ID NO: 207465 - DNA, 25 bp, E. coli
gcttttatcatcactctgaaacggg

SEQ ID NO: 207466 - DNA, 25 bp, E. coli
gtcatcacgacgctggcccgttatt

SEQ ID NO: 207467 - DNA, 25 bp, E. coli
gaaaaaatgtgaagtgcctcgccgt

SEQ ID NO: 207468 - DNA, 25 bp, E. coli
gaaaaaatgtgatgtgcctcgccgt

SEQ ID NO: 207469 - DNA, 25 bp, E. coli
cggcctacaaagtaatgcacatatt

SEQ ID NO: 207470 - DNA, 25 bp, E. coli
cggcctacaaagaaatgcacatatt

SEQ ID NO: 207471 - DNA, 25 bp, E. coli
gttgcgccttatcttcaaattcctg

SEQ ID NO: 207472 - DNA, 25 bp, E. coli
gttgcgccttatgttcaaattcctg

SEQ ID NO: 207473 - DNA, 25 bp, E. coli
taaaaggccttacggcagacctgcg

SEQ ID NO: 207474 - DNA, 25 bp, E. coli
taaaaggccttagggcagacctgcg

SEQ ID NO: 207475 - DNA, 25 bp, E. coli
tattccgactttaagctgagtgcga

SEQ ID NO: 207476 - DNA, 25 bp, E. coli
tattccgacttttagctgagtgcga

SEQ ID NO: 207477 - DNA, 25 bp, E. coli
tgcgaacgcatgaaccccaattacg

SEQ ID NO: 207478 - DNA, 25 bp, E. coli
tgagtaagacctgcatcacgaccgt

SEQ ID NO: 207479 - DNA, 25 bp, E. coli
tgagtaagacctccatcacgaccgt

SEQ ID NO: 207480 - DNA, 25 bp, E. coli
tgcgaacgcatgtaccccaattacg

SEQ ID NO: 207481 - DNA, 25 bp, E. coli
tcgaacacgcggtggaagtgagtaa

SEQ ID NO: 207482 - DNA, 25 bp, E. coli
tcgaacacgcggaggaagtgagtaa

SEQ ID NO: 207483 - DNA, 25 bp, E. coli
tgcgtggcgttatgtgaactggtcc

SEQ ID NO: 207484 - DNA, 25 bp, E. coli
tgcgtggcgttaagtgaactggtcc

SEQ ID NO: 207485 - DNA, 25 bp, E. coli
ccagctgtagagcaagaatgggaca

SEQ ID NO: 207486 - DNA, 25 bp, E. coli
ccagctgtagaggaagaatgggaca

SEQ ID NO: 207487 - DNA, 25 bp, E. coli
gaagaagcgattgcttcagccgacg

SEQ ID NO: 207488 - DNA, 25 bp, E. coli
gaagaagcgattccttcagccgacg

SEQ ID NO: 207489 - DNA, 25 bp, E. coli
gtaaatttcgacagccaactggaga

SEQ ID NO: 207490 - DNA, 25 bp, E. coli
gtaaatttcgactgccaactggaga

SEQ ID NO: 207491 - DNA, 25 bp, E. coli
ggaaatgactcaggctggtcgcgaa

SEQ ID NO: 207492 - DNA, 25 bp, E. coli
ggaaatgactcacgctggtcgcgaa

SEQ ID NO: 207493 - DNA, 25 bp, E. coli
gatctgtacggcctttatccggcaa

SEQ ID NO: 207494 - DNA, 25 bp, E. coli
gatctgtacggcgtttatccggcaa

SEQ ID NO: 207495 - DNA, 25 bp, E. coli
tatcgcccccgacacggtggctaac

SEQ ID NO: 207496 - DNA, 25 bp, E. coli
tatcgcccccgagacggtggctaac

SEQ ID NO: 207497 - DNA, 25 bp, E. coli
atgtccgcgcgatgttgttcactct

SEQ ID NO: 207498 - DNA, 25 bp, E. coli
atgtccgcgcgaagttgttcactct

SEQ ID NO: 207499 - DNA, 25 bp, E. coli
tgtccgcgcgaacttgttcactctg

SEQ ID NO: 207500 - DNA, 25 bp, E. coli
tgtccgcgcgaagttgttcactctg

SEQ ID NO: 207501 - DNA, 25 bp, E. coli
tccgcgcgaagtagttcactctgaa

SEQ ID NO: 207502 - DNA, 25 bp, E. coli
tcgcccccgacacggtggctaactt

SEQ ID NO: 207503 - DNA, 25 bp, E. coli
tcgcccccgacagggtggctaactt

SEQ ID NO: 207504 - DNA, 25 bp, E. coli
tccgcgcgaagttgttcactctgaa

SEQ ID NO: 207505 - DNA, 25 bp, E. coli
gcctgcggatgtgcgcgcgaagttg

SEQ ID NO: 207506 - DNA, 25 bp, E. coli
gcctgcggatgtccgcgcgaagttg

SEQ ID NO: 207507 - DNA, 25 bp, E. coli
cgcctgcggatgtccgcgcgaagtt

SEQ ID NO: 207508 - DNA, 25 bp, E. coli
ccgcgcgaagttgttcactctgaaa

SEQ ID NO: 207509 - DNA, 25 bp, E. coli
cgcctgcggatgaccgcgcgaagtt

SEQ ID NO: 207510 - DNA, 25 bp, E. coli
ccgcgcgaagttcttcactctgaaa

SEQ ID NO: 207511 - DNA, 25 bp, E. coli
gtccgcgcgaagttgttcactctga

SEQ ID NO: 207512 - DNA, 25 bp, E. coli
ggatgtccgcgcgaagttgttcact

SEQ ID NO: 207513 - DNA, 25 bp, E. coli
gtccgcgcgaagatgttcactctga

SEQ ID NO: 207514 - DNA, 25 bp, E. coli
ggatgtccgcgccaagttgttcact

SEQ ID NO: 207515 - DNA, 25 bp, E. coli
gatgtccgcgcgaagttgttcactc

SEQ ID NO: 207516 - DNA, 25 bp, E. coli
gatgtccgcgcgtagttgttcactc

SEQ ID NO: 207517 - DNA, 25 bp, E. coli
aatcggtgctgcgatcggtatcggc

SEQ ID NO: 207518 - DNA, 25 bp, E. coli
aatcggtgctgccatcggtatcggc

SEQ ID NO: 207519 - DNA, 25 bp, E. coli
tatgggtctggtggatgctatcccg

SEQ ID NO: 207520 - DNA, 25 bp, E. coli
tatgggtctggtcgatgctatcccg

SEQ ID NO: 207521 - DNA, 25 bp, E. coli
tctgtacgtgatgttcgctgtcgcg

SEQ ID NO: 207522 - DNA, 25 bp, E. coli
tctgtacgtgatcttcgctgtcgcg

SEQ ID NO: 207523 - DNA, 25 bp, E. coli
cctgatctgattcctctgctgcgta

SEQ ID NO: 207524 - DNA, 25 bp, E. coli
cctgatctgattgctctgctgcgta

SEQ ID NO: 207525 - DNA, 25 bp, E. coli
gcgcagcgcgtctacctgatctgat

SEQ ID NO: 207526 - DNA, 25 bp, E. coli
gcgcagcgcgtcaacctgatctgat

SEQ ID NO: 207527 - DNA, 25 bp, E. coli
gtactcagttctatatcgttatggg

SEQ ID NO: 207528 - DNA, 25 bp, E. coli
gtactcagttctttatcgttatggg

SEQ ID NO: 207529 - DNA, 25 bp, E. coli
gatctgctgtacttggctgccgctg

SEQ ID NO: 207530 - DNA, 25 bp, E. coli
gtaaattcctggtaggcgcagcgcg

SEQ ID NO: 207531 - DNA, 25 bp, E. coli
gtaaattcctggaaggcgcagcgcg

SEQ ID NO: 207532 - DNA, 25 bp, E. coli
ggaaaacctgaatatggatctgctg

SEQ ID NO: 207533 - DNA, 25 bp, E. coli
ggaaaacctgaaaatggatctgctg

SEQ ID NO: 207534 - DNA, 25 bp, E. coli
gatcgctgtaggtctgggtctgtac

SEQ ID NO: 207535 - DNA, 25 bp, E. coli
gatctgctgtacatggctgccgctg

SEQ ID NO: 207536 - DNA, 25 bp, E. coli
gatgctatcccgttgatcgctgtag

SEQ ID NO: 207537 - DNA, 25 bp, E. coli
gatcgctgtaggactgggtctgtac

SEQ ID NO: 207538 - DNA, 25 bp, E. coli
gatgctatcccgatgatcgctgtag

SEQ ID NO: 207539 - DNA, 25 bp, E. coli
aaggttttgttttgacattcagtgc

SEQ ID NO: 207540 - DNA, 25 bp, E. coli
aaggttttgtttagacattcagtgc

SEQ ID NO: 207541 - DNA, 25 bp, E. coli
catattcgtgttggattattctgca

SEQ ID NO: 207542 - DNA, 25 bp, E. coli
catattcgtgttcgattattctgca

SEQ ID NO: 207543 - DNA, 25 bp, E. coli
tacattttgaaagatctatagcgat

SEQ ID NO: 207544 - DNA, 25 bp, E. coli
taaaggcatatatcagagggttaat

SEQ ID NO: 207545 - DNA, 25 bp, E. coli
tacattttgaaacatctatagcgat

SEQ ID NO: 207546 - DNA, 25 bp, E. coli
taaaggcatataacagagggttaat

SEQ ID NO: 207547 - DNA, 25 bp, E. coli
tgatgttaggtgcttatttcgccat

SEQ ID NO: 207548 - DNA, 25 bp, E. coli
tgatgttaggtggttatttcgccat

SEQ ID NO: 207549 - DNA, 25 bp, E. coli
gccattccgcaataatcttaaaaag

SEQ ID NO: 207550 - DNA, 25 bp, E. coli
gccattccgcaaaaatcttaaaaag

SEQ ID NO: 207551 - DNA, 25 bp, E. coli
cattcagtgctgacaaatacttaag

SEQ ID NO: 207552 - DNA, 25 bp, E. coli
cttgccgactgattaatgagggtta

SEQ ID NO: 207553 - DNA, 25 bp, E. coli
cttgccgactgaataatgagggtta

SEQ ID NO: 207554 - DNA, 25 bp, E. coli
cattcagtgctgtcaaatacttaag

SEQ ID NO: 207555 - DNA, 25 bp, E. coli
gggagaatggacatgccgactgatt

SEQ ID NO: 207556 - DNA, 25 bp, E. coli
gggagaatggacttgccgactgatt

SEQ ID NO: 207557 - DNA, 25 bp, E. coli
gagggttaatcagtatgcagtggca

SEQ ID NO: 207558 - DNA, 25 bp, E. coli
gagttattctagttgcgagtgaagg

SEQ ID NO: 207559 - DNA, 25 bp, E. coli
gagttattctagatgcgagtgaagg

SEQ ID NO: 207560 - DNA, 25 bp, E. coli
gagggttaatcactatgcagtggca

SEQ ID NO: 207561 - DNA, 25 bp, E. coli
caagcttttagtgcgtttcctgagg

SEQ ID NO: 207562 - DNA, 25 bp, E. coli
caagcttttagtccgtttcctgagg

SEQ ID NO: 207563 - DNA, 25 bp, E. coli
aactggttgaggattcagggcatcc

SEQ ID NO: 207564 - DNA, 25 bp, E. coli
aactggttgaggtttcagggcatcc

SEQ ID NO: 207565 - DNA, 25 bp, E. coli
aaaccattgctaggtggctggcggc

SEQ ID NO: 207566 - DNA, 25 bp, E. coli
aaaccattgctacgtggctggcggc

SEQ ID NO: 207567 - DNA, 25 bp, E. coli
tattgcctcctgtagagtgtgagca

SEQ ID NO: 207568 - DNA, 25 bp, E. coli
tattgcctcctgaagagtgtgagca

SEQ ID NO: 207569 - DNA, 25 bp, E. coli
ttcttcaggaaagtggatggagcca

SEQ ID NO: 207570 - DNA, 25 bp, E. coli
ttcttcaggaaactggatggagcca

SEQ ID NO: 207571 - DNA, 25 bp, E. coli
gcccgtagaattcgtgtgacacaac

SEQ ID NO: 207572 - DNA, 25 bp, E. coli
gccaggctgagcatgcccgtagaat

SEQ ID NO: 207573 - DNA, 25 bp, E. coli
gcccgtagaattggtgtgacacaac

SEQ ID NO: 207574 - DNA, 25 bp, E. coli
gccaggctgagcttgcccgtagaat

SEQ ID NO: 207575 - DNA, 25 bp, E. coli
gctacacctaaagcctcaagtttgg

SEQ ID NO: 207576 - DNA, 25 bp, E. coli
gctacacctaaaccctcaagtttgg

SEQ ID NO: 207577 - DNA, 25 bp, E. coli
gaaaattggtccacgccaacgcgaa

SEQ ID NO: 207578 - DNA, 25 bp, E. coli
gaaaattggtcctcgccaacgcgaa

SEQ ID NO: 207579 - DNA, 25 bp, E. coli
tcaacaatgggtcagcggtaaggct

SEQ ID NO: 207580 - DNA, 25 bp, E. coli
tcaacaatgggtgagcggtaaggct

SEQ ID NO: 207581 - DNA, 25 bp, E. coli
gagcaaattttcacccctgacacga

SEQ ID NO: 207582 - DNA, 25 bp, E. coli
gagcaaattttctcccctgacacga

SEQ ID NO: 207583 - DNA, 25 bp, E. coli
cagatggacattcagaacttcgacg

SEQ ID NO: 207584 - DNA, 25 bp, E. coli
cagatggacattgagaacttcgacg

SEQ ID NO: 207585 - DNA, 25 bp, E. coli
agatggacattgtgaacttcgacgt

SEQ ID NO: 207586 - DNA, 25 bp, E. coli
agatggacattgagaacttcgacgt

SEQ ID NO: 207587 - DNA, 25 bp, E. coli
actatcaatcttgggttcgtgcaga

SEQ ID NO: 207588 - DNA, 25 bp, E. coli
actatcaatcttcggttcgtgcaga

SEQ ID NO: 207589 - DNA, 25 bp, E. coli
tatcaatcttggcttcgtgcagatc

SEQ ID NO: 207590 - DNA, 25 bp, E. coli
tatcaatcttgggttcgtgcagatc

SEQ ID NO: 207591 - DNA, 25 bp, E. coli
tgcagatggacaatgagaacttcga

SEQ ID NO: 207592 - DNA, 25 bp, E. coli
tgcagatggacattgagaacttcga

SEQ ID NO: 207593 - DNA, 25 bp, E. coli
gcagatggacatagagaacttcgac

SEQ ID NO: 207594 - DNA, 25 bp, E. coli
gcagatggacattgagaacttcgac

SEQ ID NO: 207595 - DNA, 25 bp, E. coli
gtgcagatggactttgagaacttcg

SEQ ID NO: 207596 - DNA, 25 bp, E. coli
gtgcagatggacattgagaacttcg

SEQ ID NO: 207597 - DNA, 25 bp, E. coli
ggacattgagaagttcgacgttagc

SEQ ID NO: 207598 - DNA, 25 bp, E. coli
tggacattgagatcttcgacgttag

SEQ ID NO: 207599 - DNA, 25 bp, E. coli
ggacattgagaacttcgacgttagc

SEQ ID NO: 207600 - DNA, 25 bp, E. coli
tggacattgagaacttcgacgttag

SEQ ID NO: 207601 - DNA, 25 bp, E. coli
tcaatcttgggtacgtgcagatccc

SEQ ID NO: 207602 - DNA, 25 bp, E. coli
tcaatcttgggttcgtgcagatccc

SEQ ID NO: 207603 - DNA, 25 bp, E. coli
gatggacattgacaacttcgacgtt

SEQ ID NO: 207604 - DNA, 25 bp, E. coli
gatggacattgagaacttcgacgtt

SEQ ID NO: 207605 - DNA, 25 bp, E. coli
caatccgttgaacaggcgtatgccg

SEQ ID NO: 207606 - DNA, 25 bp, E. coli
caatccgttgaagaggcgtatgccg

SEQ ID NO: 207607 - DNA, 25 bp, E. coli
caaagtgatgcacgcgtttccaggt

SEQ ID NO: 207608 - DNA, 25 bp, E. coli
caaagtgatgcaggcgtttccaggt

SEQ ID NO: 207609 - DNA, 25 bp, E. coli
cagggcgcacgctttcttaaccaga

SEQ ID NO: 207610 - DNA, 25 bp, E. coli
cagggcgcacgcattcttaaccaga

SEQ ID NO: 207611 - DNA, 25 bp, E. coli
tactggaatgcgctaccgctggaaa

SEQ ID NO: 207612 - DNA, 25 bp, E. coli
tactggaatgcggtaccgctggaaa

SEQ ID NO: 207613 - DNA, 25 bp, E. coli
tatgaaagcgtacaaacctgacgtg

SEQ ID NO: 207614 - DNA, 25 bp, E. coli
tatgaaagcgtagaaacctgacgtg

SEQ ID NO: 207615 - DNA, 25 bp, E. coli
ttagcgtggatgctgtcgccaacac

SEQ ID NO: 207616 - DNA, 25 bp, E. coli
ttagcgtggatggtgtcgccaacac

SEQ ID NO: 207617 - DNA, 25 bp, E. coli
tcgtatctctggtctgcgtggaaaa

SEQ ID NO: 207618 - DNA, 25 bp, E. coli
tcatgaacaaaacggtattgcgggc

SEQ ID NO: 207619 - DNA, 25 bp, E. coli
tcatgaacaaaagggtattgcgggc

SEQ ID NO: 207620 - DNA, 25 bp, E. coli
tcgtatctctggactgcgtggaaaa

SEQ ID NO: 207621 - DNA, 25 bp, E. coli
tggcggttgcgctccatctaatggc

SEQ ID NO: 207622 - DNA, 25 bp, E. coli
tggcggttgcgcaccatctaatggc

SEQ ID NO: 207623 - DNA, 25 bp, E. coli
tcactatctggcatcagagcggcaa

SEQ ID NO: 207624 - DNA, 25 bp, E. coli
taatggctcagggttggcaagttcg

SEQ ID NO: 207625 - DNA, 25 bp, E. coli
taatggctcaggcttggcaagttcg

SEQ ID NO: 207626 - DNA, 25 bp, E. coli
tcactatctggcttcagagcggcaa

SEQ ID NO: 207627 - DNA, 25 bp, E. coli
catctttgagttccggttattacac

SEQ ID NO: 207628 - DNA, 25 bp, E. coli
catctttgagttgcggttattacac

SEQ ID NO: 207629 - DNA, 25 bp, E. coli
aaactcaacgcctggtaatgcggcc

SEQ ID NO: 207630 - DNA, 25 bp, E. coli
aaactcaacgccaggtaatgcggcc

SEQ ID NO: 207631 - DNA, 25 bp, E. coli
tccagaagtggacaggtgcaagata

SEQ ID NO: 207632 - DNA, 25 bp, E. coli
tccagaagtggagaggtgcaagata

SEQ ID NO: 207633 - DNA, 25 bp, E. coli
tcccgcatgggtaccaaagacaaca

SEQ ID NO: 207634 - DNA, 25 bp, E. coli
tcccgcatgggttccaaagacaaca

SEQ ID NO: 207635 - DNA, 25 bp, E. coli
tctgccggtccgtaatgtgatcgtg

SEQ ID NO: 207636 - DNA, 25 bp, E. coli
tctgcgatgtgaaattgctctccta

SEQ ID NO: 207637 - DNA, 25 bp, E. coli
tctgcgatgtgatattgctctccta

SEQ ID NO: 207638 - DNA, 25 bp, E. coli
tctgccggtccgaaatgtgatcgtg

SEQ ID NO: 207639 - DNA, 25 bp, E. coli
gctaaatttatgcacgttctcactg

SEQ ID NO: 207640 - DNA, 25 bp, E. coli
gctaaatttatggacgttctcactg

SEQ ID NO: 207641 - DNA, 25 bp, E. coli
gaataattccttactgccggtccga

SEQ ID NO: 207642 - DNA, 25 bp, E. coli
gaataattcctttctgccggtccga

SEQ ID NO: 207643 - DNA, 25 bp, E. coli
ggattaatctgcagtgcattcgaca

SEQ ID NO: 207644 - DNA, 25 bp, E. coli
ggttaaaaagaacacatcccgcatg

SEQ ID NO: 207645 - DNA, 25 bp, E. coli
ggttaaaaagaagacatcccgcatg

SEQ ID NO: 207646 - DNA, 25 bp, E. coli
ggattaatctgctgtgcattcgaca

SEQ ID NO: 207647 - DNA, 25 bp, E. coli
taatgcggcctaatgactggttaaa

SEQ ID NO: 207648 - DNA, 25 bp, E. coli
taatgcggcctattgactggttaaa

SEQ ID NO: 207649 - DNA, 25 bp, E. coli
caattatcatgcgttaatagctgcg

SEQ ID NO: 207650 - DNA, 25 bp, E. coli
caattatcatgccttaatagctgcg

SEQ ID NO: 207651 - DNA, 25 bp, E. coli
cagttctcattatcaggcattatcc

SEQ ID NO: 207652 - DNA, 25 bp, E. coli
cagttctcattaacaggcattatcc

SEQ ID NO: 207653 - DNA, 25 bp, E. coli
taaagccagcgaaatttaagaccgc

SEQ ID NO: 207654 - DNA, 25 bp, E. coli
taaagccagcgatatttaagaccgc

SEQ ID NO: 207655 - DNA, 25 bp, E. coli
tattaaagccctctttgccgaaagg

SEQ ID NO: 207656 - DNA, 25 bp, E. coli
tattaaagccctgtttgccgaaagg

SEQ ID NO: 207657 - DNA, 25 bp, E. coli
aaaatactgcgctgcactatacggg

SEQ ID NO: 207658 - DNA, 25 bp, E. coli
aaaatactgcgcagcactatacggg

SEQ ID NO: 207659 - DNA, 25 bp, E. coli
ttccttactgaatatactgcgctgc

SEQ ID NO: 207660 - DNA, 25 bp, E. coli
ttccttactgaaaatactgcgctgc

SEQ ID NO: 207661 - DNA, 25 bp, E. coli
tgccgaaaggccgaaaatgaaggaa

SEQ ID NO: 207662 - DNA, 25 bp, E. coli
tcggtttgaaagacagacagcatac

SEQ ID NO: 207663 - DNA, 25 bp, E. coli
tcggtttgaaagtcagacagcatac

SEQ ID NO: 207664 - DNA, 25 bp, E. coli
tgccgaaaggcccaaaatgaaggaa

SEQ ID NO: 207665 - DNA, 25 bp, E. coli
cgatatttaagaccgccggacggct

SEQ ID NO: 207666 - DNA, 25 bp, E. coli
cgatatttaagagcgccggacggct

SEQ ID NO: 207667 - DNA, 25 bp, E. coli
ggcattatccccttcttttgagtct

SEQ ID NO: 207668 - DNA, 25 bp, E. coli
ggcattatccccatcttttgagtct

SEQ ID NO: 207669 - DNA, 25 bp, E. coli
gagtctctctcctgaacactaagta

SEQ ID NO: 207670 - DNA, 25 bp, E. coli
gagtctctctccagaacactaagta

SEQ ID NO: 207671 - DNA, 25 bp, E. coli
accagaaaggatcctttttacactg

SEQ ID NO: 207672 - DNA, 25 bp, E. coli
accagaaaggatgctttttacactg

SEQ ID NO: 207673 - DNA, 25 bp, E. coli
aaccagaaaggatgctttttacact

SEQ ID NO: 207674 - DNA, 25 bp, E. coli
aaccagaaaggaagctttttacact

SEQ ID NO: 207675 - DNA, 25 bp, E. coli
tatatggtcaaataaggaaccagaa

SEQ ID NO: 207676 - DNA, 25 bp, E. coli
tatatggtcaaaaaaggaaccagaa

SEQ ID NO: 207677 - DNA, 25 bp, E. coli
tgaacccgtctggtgtaatatcgct

SEQ ID NO: 207678 - DNA, 25 bp, E. coli
tgaacccgtctgctgtaatatcgct

SEQ ID NO: 207679 - DNA, 25 bp, E. coli
tctggtgtaataacgctggcgatcc

SEQ ID NO: 207680 - DNA, 25 bp, E. coli
tctggtgtaatatcgctggcgatcc

SEQ ID NO: 207681 - DNA, 25 bp, E. coli
gctatatggtcaaaaaaggaaccag

SEQ ID NO: 207682 - DNA, 25 bp, E. coli
gctggcgatcccatgctatatggtc

SEQ ID NO: 207683 - DNA, 25 bp, E. coli
gctatatggtcataaaaggaaccag

SEQ ID NO: 207684 - DNA, 25 bp, E. coli
gctggcgatcccttgctatatggtc

SEQ ID NO: 207685 - DNA, 25 bp, E. coli
gaaccagaaaggttgctttttacac

SEQ ID NO: 207686 - DNA, 25 bp, E. coli
gaaccagaaaggatgctttttacac

SEQ ID NO: 207687 - DNA, 25 bp, E. coli
gatcccttgctatatggtcaaaaaa

SEQ ID NO: 207688 - DNA, 25 bp, E. coli
gatcccttgctaaatggtcaaaaaa

SEQ ID NO: 207689 - DNA, 25 bp, E. coli
ggaaccagaaagcatgctttttaca

SEQ ID NO: 207690 - DNA, 25 bp, E. coli
ggaaccagaaaggatgctttttaca

SEQ ID NO: 207691 - DNA, 25 bp, E. coli
ggcgatcccttggtatatggtcaaa

SEQ ID NO: 207692 - DNA, 25 bp, E. coli
ggcgatcccttgctatatggtcaaa

SEQ ID NO: 207693 - DNA, 25 bp, E. coli
caccttcgtgatccgggcagataac

SEQ ID NO: 207694 - DNA, 25 bp, E. coli
caccttcgtgatgcgggcagataac

SEQ ID NO: 207695 - DNA, 25 bp, E. coli
cacttcgtgaatctttgtccggcca

SEQ ID NO: 207696 - DNA, 25 bp, E. coli
cacttcgtgaatgtttgtccggcca

SEQ ID NO: 207697 - DNA, 25 bp, E. coli
catggcacggctttggtcggtaagc

SEQ ID NO: 207698 - DNA, 25 bp, E. coli
catggcacggctatggtcggtaagc

SEQ ID NO: 207699 - DNA, 25 bp, E. coli
tttgagcactcctgcaacctggcgg

SEQ ID NO: 207700 - DNA, 25 bp, E. coli
tttgagcactccagcaacctggcgg

SEQ ID NO: 207701 - DNA, 25 bp, E. coli
tgaacatggtaactctctggaagcg

SEQ ID NO: 207702 - DNA, 25 bp, E. coli
tgaacatggtaagtctctggaagcg

SEQ ID NO: 207703 - DNA, 25 bp, E. coli
tccgaaatggagacagggcaaatct

SEQ ID NO: 207704 - DNA, 25 bp, E. coli
tccgaaatggagtcagggcaaatct

SEQ ID NO: 207705 - DNA, 25 bp, E. coli
tctgggatatttctcgccgatgcgc

SEQ ID NO: 207706 - DNA, 25 bp, E. coli
tctgggatatttgtcgccgatgcgc

SEQ ID NO: 207707 - DNA, 25 bp, E. coli
tcggcgcgaacctcatcaatgctgg

SEQ ID NO: 207708 - DNA, 25 bp, E. coli
tcggcgcgaaccacatcaatgctgg

SEQ ID NO: 207709 - DNA, 25 bp, E. coli
cattgaaggtctcgaaatcgtcgcc

SEQ ID NO: 207710 - DNA, 25 bp, E. coli
cattgaaggtctggaaatcgtcgcc

SEQ ID NO: 207711 - DNA, 25 bp, E. coli
gattctgttaacactgcgcaccgaa

SEQ ID NO: 207712 - DNA, 25 bp, E. coli
gattctgttaactctgcgcaccgaa

SEQ ID NO: 207713 - DNA, 25 bp, E. coli
tggatgctctatgtcgcggtcgtga

SEQ ID NO: 207714 - DNA, 25 bp, E. coli
tggatgctctatctcgcggtcgtga

SEQ ID NO: 207715 - DNA, 25 bp, E. coli
aattagcacaacttccgaggacagc

SEQ ID NO: 207716 - DNA, 25 bp, E. coli
cacccaattagcacaacatccgagg

SEQ ID NO: 207717 - DNA, 25 bp, E. coli
aattagcacaacatccgaggacagc

SEQ ID NO: 207718 - DNA, 25 bp, E. coli
cacccaattagctcaacatccgagg

SEQ ID NO: 207719 - DNA, 25 bp, E. coli
caattagcacaagatccgaggacag

SEQ ID NO: 207720 - DNA, 25 bp, E. coli
caattagcacaacatccgaggacag

SEQ ID NO: 207721 - DNA, 25 bp, E. coli
acatccgaggactgcaacacccgat

SEQ ID NO: 207722 - DNA, 25 bp, E. coli
acatccgaggacagcaacacccgat

SEQ ID NO: 207723 - DNA, 25 bp, E. coli
ttagcacaacatgcgaggacagcaa

SEQ ID NO: 207724 - DNA, 25 bp, E. coli
ttagcacaacatccgaggacagcaa

SEQ ID NO: 207725 - DNA, 25 bp, E. coli
tatcacccaattagcacaacatccg

SEQ ID NO: 207726 - DNA, 25 bp, E. coli
tatcacccaatttgcacaacatccg

SEQ ID NO: 207727 - DNA, 25 bp, E. coli
ttcctccgttgcttatacagctcac

SEQ ID NO: 207728 - DNA, 25 bp, E. coli
tttttcctggctaccagcaacgggg

SEQ ID NO: 207729 - DNA, 25 bp, E. coli
tttttcctggcttccagcaacgggg

SEQ ID NO: 207730 - DNA, 25 bp, E. coli
ttcctccgttgcatatacagctcac

SEQ ID NO: 207731 - DNA, 25 bp, E. coli
gcacaacatccgtggacagcaacac

SEQ ID NO: 207732 - DNA, 25 bp, E. coli
gcacaacatccgaggacagcaacac

SEQ ID NO: 207733 - DNA, 25 bp, E. coli
cctggcttccaggaacggggtttct

SEQ ID NO: 207734 - DNA, 25 bp, E. coli
cctggcttccagcaacggggtttct

SEQ ID NO: 207735 - DNA, 25 bp, E. coli
cttcctccgttggatatacagctca

SEQ ID NO: 207736 - DNA, 25 bp, E. coli
cttcctccgttgcatatacagctca

SEQ ID NO: 207737 - DNA, 25 bp, E. coli
cagagtcacctgtcagaagcaatgg

SEQ ID NO: 207738 - DNA, 25 bp, E. coli
cagagtcacctgacagaagcaatgg

SEQ ID NO: 207739 - DNA, 25 bp, E. coli
attggtgatgtaggcgacggcggcg

SEQ ID NO: 207740 - DNA, 25 bp, E. coli
aggtggtacacgcttctctggagat

SEQ ID NO: 207741 - DNA, 25 bp, E. coli
attggtgatgtacgcgacggcggcg

SEQ ID NO: 207742 - DNA, 25 bp, E. coli
acgtagcccaatcccatcagcttgg

SEQ ID NO: 207743 - DNA, 25 bp, E. coli
aggtggtacacggttctctggagat

SEQ ID NO: 207744 - DNA, 25 bp, E. coli
aaaatatcgtgaatattatcagggc

SEQ ID NO: 207745 - DNA, 25 bp, E. coli
aaaatatcgtgattattatcagggc

SEQ ID NO: 207746 - DNA, 25 bp, E. coli
acgtagcccaatgccatcagcttgg

SEQ ID NO: 207747 - DNA, 25 bp, E. coli
aaacgaggtggtacacggttctctg

SEQ ID NO: 207748 - DNA, 25 bp, E. coli
aaacgaggtggttcacggttctctg

SEQ ID NO: 207749 - DNA, 25 bp, E. coli
tagcccaatcccatcagcttggcag

SEQ ID NO: 207750 - DNA, 25 bp, E. coli
tagcccaatcccttcagcttggcag

SEQ ID NO: 207751 - DNA, 25 bp, E. coli
tgccgaaagccacagtcacctgtca

SEQ ID NO: 207752 - DNA, 25 bp, E. coli
tgccgaaagccagagtcacctgtca

SEQ ID NO: 207753 - DNA, 25 bp, E. coli
tcgccaaccgcgaaaaatatcgtga

SEQ ID NO: 207754 - DNA, 25 bp, E. coli
tcgccaaccgcgtaaaatatcgtga

SEQ ID NO: 207755 - DNA, 25 bp, E. coli
cctgtcagaagctatggacggcgaa

SEQ ID NO: 207756 - DNA, 25 bp, E. coli
cctgtcagaagcaatggacggcgaa

SEQ ID NO: 207757 - DNA, 25 bp, E. coli
tggtacagcgcgtaccggtaacgct

SEQ ID NO: 207758 - DNA, 25 bp, E. coli
tggtacagcgcgaaccggtaacgct

SEQ ID NO: 207759 - DNA, 25 bp, E. coli
catgctgaaaacctggtgtaccggc

SEQ ID NO: 207760 - DNA, 25 bp, E. coli
cagattgagcagcaagtgcttacca

SEQ ID NO: 207761 - DNA, 25 bp, E. coli
cagattgagcaggaagtgcttacca

SEQ ID NO: 207762 - DNA, 25 bp, E. coli
catgctgaaaacgtggtgtaccggc

SEQ ID NO: 207763 - DNA, 25 bp, E. coli
tactgtggaagaggccatcagaacc

SEQ ID NO: 207764 - DNA, 25 bp, E. coli
tactgtggaagacgccatcagaacc

SEQ ID NO: 207765 - DNA, 25 bp, E. coli
agaacaggcggagtcagacagcaac

SEQ ID NO: 207766 - DNA, 25 bp, E. coli
agaacaggcggactcagacagcaac

SEQ ID NO: 207767 - DNA, 25 bp, E. coli
tgttcctgaaaagcgaatcatttga

SEQ ID NO: 207768 - DNA, 25 bp, E. coli
tgttcctgaaaaccgaatcatttga

SEQ ID NO: 207769 - DNA, 25 bp, E. coli
tccatgaatgaacccgttaaacaga

SEQ ID NO: 207770 - DNA, 25 bp, E. coli
tccatgaatgaagccgttaaacaga

SEQ ID NO: 207771 - DNA, 25 bp, E. coli
gccgttaaacagtttgagcaggaag

SEQ ID NO: 207772 - DNA, 25 bp, E. coli
gccgttaaacagattgagcaggaag

SEQ ID NO: 207773 - DNA, 25 bp, E. coli
gctttctgaactgtcagccctgcag

SEQ ID NO: 207774 - DNA, 25 bp, E. coli
gctttctgaactctcagccctgcag

SEQ ID NO: 207775 - DNA, 25 bp, E. coli
gcagagcctgtttctgcgggaaagt

SEQ ID NO: 207776 - DNA, 25 bp, E. coli
gcagagcctgttactgcgggaaagt

SEQ ID NO: 207777 - DNA, 25 bp, E. coli
cggaggcaatttgtcatgctgaaaa

SEQ ID NO: 207778 - DNA, 25 bp, E. coli
cggaggcaatttctcatgctgaaaa

SEQ ID NO: 207779 - DNA, 25 bp, E. coli
ctgtttctgcgggaaagtgttcgac

SEQ ID NO: 207780 - DNA, 25 bp, E. coli
ctgtttctgcggcaaagtgttcgac

SEQ ID NO: 207781 - DNA, 25 bp, E. coli
caattacccgcaggttacaagccgg

SEQ ID NO: 207782 - DNA, 25 bp, E. coli
caattacccgcacgttacaagccgg

SEQ ID NO: 207783 - DNA, 25 bp, E. coli
cagatggtgctattggcccggcaac

SEQ ID NO: 207784 - DNA, 25 bp, E. coli
cagagaagcgattgacccatggcag

SEQ ID NO: 207785 - DNA, 25 bp, E. coli
cagagaagcgatagacccatggcag

SEQ ID NO: 207786 - DNA, 25 bp, E. coli
cagatggtgctaatggcccggcaac

SEQ ID NO: 207787 - DNA, 25 bp, E. coli
aacccatgtgggtaaaccgtgatgc

SEQ ID NO: 207788 - DNA, 25 bp, E. coli
aacccatgtgggaaaaccgtgatgc

SEQ ID NO: 207789 - DNA, 25 bp, E. coli
aaatattccggtcaaaggcactcgc

SEQ ID NO: 207790 - DNA, 25 bp, E. coli
aaatattccggtgaaaggcactcgc

SEQ ID NO: 207791 - DNA, 25 bp, E. coli
tatcagaacggcaatcaggtgctgg

SEQ ID NO: 207792 - DNA, 25 bp, E. coli
tatcagaacggctatcaggtgctgg

SEQ ID NO: 207793 - DNA, 25 bp, E. coli
ttcaactgttgtttgccgcacgcga

SEQ ID NO: 207794 - DNA, 25 bp, E. coli
ttcaactgttgtatgccgcacgcga

SEQ ID NO: 207795 - DNA, 25 bp, E. coli
tttacaattatgttctgcctgcgcg

SEQ ID NO: 207796 - DNA, 25 bp, E. coli
tttacaattatgatctgcctgcgcg

SEQ ID NO: 207797 - DNA, 25 bp, E. coli
tgactggtctactatcacggcctcg

SEQ ID NO: 207798 - DNA, 25 bp, E. coli
tgactggtctacaatcacggcctcg

SEQ ID NO: 207799 - DNA, 25 bp, E. coli
tccgggatatctggaaagccatggc

SEQ ID NO: 207800 - DNA, 25 bp, E. coli
tccgggatatctcgaaagccatggc

SEQ ID NO: 207801 - DNA, 25 bp, E. coli
gatacacgcgcattgagctcaggct

SEQ ID NO: 207802 - DNA, 25 bp, E. coli
gatacacgcgcaatgagctcaggct

SEQ ID NO: 207803 - DNA, 25 bp, E. coli
aattcttatttaactgctcgccagg

SEQ ID NO: 207804 - DNA, 25 bp, E. coli
aattcttatttatctgctcgccagg

SEQ ID NO: 207805 - DNA, 25 bp, E. coli
cacactaatagtggtaacaagcgtg

SEQ ID NO: 207806 - DNA, 25 bp, E. coli
cacactaatagtcgtaacaagcgtg

SEQ ID NO: 207807 - DNA, 25 bp, E. coli
cataattcgataaataaagacggtg

SEQ ID NO: 207808 - DNA, 25 bp, E. coli
cataattcgatatataaagacggtg

SEQ ID NO: 207809 - DNA, 25 bp, E. coli
taaagacggtgttgaggaaaagtag

SEQ ID NO: 207810 - DNA, 25 bp, E. coli
taaagacggtgtagaggaaaagtag

SEQ ID NO: 207811 - DNA, 25 bp, E. coli
tagcgagaaattgtgcatggttatg

SEQ ID NO: 207812 - DNA, 25 bp, E. coli
tatctgctcgccaggaattttcgga

SEQ ID NO: 207813 - DNA, 25 bp, E. coli
tagcgagaaattctgcatggttatg

SEQ ID NO: 207814 - DNA, 25 bp, E. coli
tatctgctcgcctggaattttcgga

SEQ ID NO: 207815 - DNA, 25 bp, E. coli
tagtggtaacaagcgtgaaaaacaa

SEQ ID NO: 207816 - DNA, 25 bp, E. coli
ttttcggaataattatgcttttgca

SEQ ID NO: 207817 - DNA, 25 bp, E. coli
tagtggtaacaaccgtgaaaaacaa

SEQ ID NO: 207818 - DNA, 25 bp, E. coli
ttttcggaataaatatgcttttgca

SEQ ID NO: 207819 - DNA, 25 bp, E. coli
gctcgccaggaattttcggaataaa

SEQ ID NO: 207820 - DNA, 25 bp, E. coli
gctcgccaggaaatttcggaataaa

SEQ ID NO: 207821 - DNA, 25 bp, E. coli
ggaaaagtagcgagaaattctgcat

SEQ ID NO: 207822 - DNA, 25 bp, E. coli
ggctgttcctatcacactaatagtg

SEQ ID NO: 207823 - DNA, 25 bp, E. coli
ggctgttcctatgacactaatagtg

SEQ ID NO: 207824 - DNA, 25 bp, E. coli
ggaaaagtagcgtgaaattctgcat

SEQ ID NO: 207825 - DNA, 25 bp, E. coli
caacgaaatgaactggtgatggcca

SEQ ID NO: 207826 - DNA, 25 bp, E. coli
caacgaaatgaagtggtgatggcca

SEQ ID NO: 207827 - DNA, 25 bp, E. coli
aactggccccgtatgatgatgcacc

SEQ ID NO: 207828 - DNA, 25 bp, E. coli
aactggccccgtttgatgatgcacc

SEQ ID NO: 207829 - DNA, 25 bp, E. coli
tattgatgagtactccgtcgcgttc

SEQ ID NO: 207830 - DNA, 25 bp, E. coli
tattgatgagtagtccgtcgcgttc

SEQ ID NO: 207831 - DNA, 25 bp, E. coli
tgcagcggccagaagtgaagatccc

SEQ ID NO: 207832 - DNA, 25 bp, E. coli
tgcagcggccagtagtgaagatccc

SEQ ID NO: 207833 - DNA, 25 bp, E. coli
gccaaaacctggagccggagtcgat

SEQ ID NO: 207834 - DNA, 25 bp, E. coli
gccaaaacctggtgccggagtcgat

SEQ ID NO: 207835 - DNA, 25 bp, E. coli
gactgggacgatgttgctttgccga

SEQ ID NO: 207836 - DNA, 25 bp, E. coli
gacagcgtattcaggccgatgccaa

SEQ ID NO: 207837 - DNA, 25 bp, E. coli
gactgggacgatcttgctttgccga

SEQ ID NO: 207838 - DNA, 25 bp, E. coli
gacagcgtattctggccgatgccaa

SEQ ID NO: 207839 - DNA, 25 bp, E. coli
gataaaataaaatgcggactcggcg

SEQ ID NO: 207840 - DNA, 25 bp, E. coli
gataaaataaaaagcggactcggcg

SEQ ID NO: 207841 - DNA, 25 bp, E. coli
ggttcgcacagctaaaagatgcctg

SEQ ID NO: 207842 - DNA, 25 bp, E. coli
ggttcgcacagcaaaaagatgcctg

SEQ ID NO: 207843 - DNA, 25 bp, E. coli
taatgatccgtaggcttaaccgcac

SEQ ID NO: 207844 - DNA, 25 bp, E. coli
taatacagcgctcgcaaacagagcc

SEQ ID NO: 207845 - DNA, 25 bp, E. coli
taatacagcgctggcaaacagagcc

SEQ ID NO: 207846 - DNA, 25 bp, E. coli
taatgatccgtacgcttaaccgcac

SEQ ID NO: 207847 - DNA, 25 bp, E. coli
cacggccggagcttcgatggcagcc

SEQ ID NO: 207848 - DNA, 25 bp, E. coli
cacggccggagcatcgatggcagcc

SEQ ID NO: 207849 - DNA, 25 bp, E. coli
agcatcgatggcagcctggggtgca

SEQ ID NO: 207850 - DNA, 25 bp, E. coli
agcatcgatggctgcctggggtgca

SEQ ID NO: 207851 - DNA, 25 bp, E. coli
acggccggagcatcgatggcagcct

SEQ ID NO: 207852 - DNA, 25 bp, E. coli
agcctggggtgctgcgctgagtgcc

SEQ ID NO: 207853 - DNA, 25 bp, E. coli
agcctggggtgcagcgctgagtgcc

SEQ ID NO: 207854 - DNA, 25 bp, E. coli
acggccggagcaacgatggcagcct

SEQ ID NO: 207855 - DNA, 25 bp, E. coli
ttcacggccggagcatcgatggcag

SEQ ID NO: 207856 - DNA, 25 bp, E. coli
ttcacggccggaccatcgatggcag

SEQ ID NO: 207857 - DNA, 25 bp, E. coli
gcctggggtgcagcgctgagtgccg

SEQ ID NO: 207858 - DNA, 25 bp, E. coli
gccggagcatcgttggcagcctggg

SEQ ID NO: 207859 - DNA, 25 bp, E. coli
gccggagcatcgatggcagcctggg

SEQ ID NO: 207860 - DNA, 25 bp, E. coli
gcctggggtgcaccgctgagtgccg

SEQ ID NO: 207861 - DNA, 25 bp, E. coli
cgatggcagcctcgggtgcagcgct

SEQ ID NO: 207862 - DNA, 25 bp, E. coli
cgatggcagcctggggtgcagcgct

SEQ ID NO: 207863 - DNA, 25 bp, E. coli
cggccggagcatggatggcagcctg

SEQ ID NO: 207864 - DNA, 25 bp, E. coli
cttcacggccggagcatcgatggca

SEQ ID NO: 207865 - DNA, 25 bp, E. coli
cggccggagcatcgatggcagcctg

SEQ ID NO: 207866 - DNA, 25 bp, E. coli
cttcacggccggtgcatcgatggca

SEQ ID NO: 207867 - DNA, 25 bp, E. coli
ggccggagcatcgatggcagcctgg

SEQ ID NO: 207868 - DNA, 25 bp, E. coli
ggccggagcatccatggcagcctgg

SEQ ID NO: 207869 - DNA, 25 bp, E. coli
cagtttgtaattaaagcgcaagaat

SEQ ID NO: 207870 - DNA, 25 bp, E. coli
cagtttgtaatttaagcgcaagaat

SEQ ID NO: 207871 - DNA, 25 bp, E. coli
taaatgaaaacgtatactctactgc

SEQ ID NO: 207872 - DNA, 25 bp, E. coli
taaatgaaaacgaatactctactgc

SEQ ID NO: 207873 - DNA, 25 bp, E. coli
acgcagaaggccaggcgtaatgtca

SEQ ID NO: 207874 - DNA, 25 bp, E. coli
acgcagaaggcctggcgtaatgtca

SEQ ID NO: 207875 - DNA, 25 bp, E. coli
ttgacgccaccatcatcggtgcagt

SEQ ID NO: 207876 - DNA, 25 bp, E. coli
ttgacgccaccaacatcggtgcagt

SEQ ID NO: 207877 - DNA, 25 bp, E. coli
tgcgctcctttcatgagctaagcaa

SEQ ID NO: 207878 - DNA, 25 bp, E. coli
tgcgctcctttcttgagctaagcaa

SEQ ID NO: 207879 - DNA, 25 bp, E. coli
gcgcaagaatatctttaaatgaaaa

SEQ ID NO: 207880 - DNA, 25 bp, E. coli
ccaacatcggtgcagtttgtaatta

SEQ ID NO: 207881 - DNA, 25 bp, E. coli
cctggcgtaatgacaggcctttttt

SEQ ID NO: 207882 - DNA, 25 bp, E. coli
gcgcaagaatatgtttaaatgaaaa

SEQ ID NO: 207883 - DNA, 25 bp, E. coli
cctggcgtaatgtcaggcctttttt

SEQ ID NO: 207884 - DNA, 25 bp, E. coli
ccaacatcggtggagtttgtaatta

SEQ ID NO: 207885 - DNA, 25 bp, E. coli
gctaagcaacattttgccactggcg

SEQ ID NO: 207886 - DNA, 25 bp, E. coli
gctaagcaacatattgccactggcg

SEQ ID NO: 207887 - DNA, 25 bp, E. coli
gaatactctactgctccttatgcat

SEQ ID NO: 207888 - DNA, 25 bp, E. coli
gaatactctactcctccttatgcat

SEQ ID NO: 207889 - DNA, 25 bp, E. coli
gattcatcatcttgttgcgctcctt

SEQ ID NO: 207890 - DNA, 25 bp, E. coli
gattcatcatctagttgcgctcctt

SEQ ID NO: 207891 - DNA, 25 bp, E. coli
caagcaaagggttagagtgtctcgt

SEQ ID NO: 207892 - DNA, 25 bp, E. coli
aatagcaggtgtatatccgcacaac

SEQ ID NO: 207893 - DNA, 25 bp, E. coli
caagcaaagggtaagagtgtctcgt

SEQ ID NO: 207894 - DNA, 25 bp, E. coli
aatagcaggtgtttatccgcacaac

SEQ ID NO: 207895 - DNA, 25 bp, E. coli
aaaccaaatttccacgcgctatcga

SEQ ID NO: 207896 - DNA, 25 bp, E. coli
aaaccaaatttcgacgcgctatcga

SEQ ID NO: 207897 - DNA, 25 bp, E. coli
tatcgaaacgcctctccattagctg

SEQ ID NO: 207898 - DNA, 25 bp, E. coli
tagctgcaatttcagcaagcaaagg

SEQ ID NO: 207899 - DNA, 25 bp, E. coli
tagctgcaatttgagcaagcaaagg

SEQ ID NO: 207900 - DNA, 25 bp, E. coli
tatcgaaacgccactccattagctg

SEQ ID NO: 207901 - DNA, 25 bp, E. coli
tgtttgtcatgctgtagacggatca

SEQ ID NO: 207902 - DNA, 25 bp, E. coli
tgtttgtcatgcagtagacggatca

SEQ ID NO: 207903 - DNA, 25 bp, E. coli
gcctgaagagtatcccaacggcctt

SEQ ID NO: 207904 - DNA, 25 bp, E. coli
gcctgaagagtaacccaacggcctt

SEQ ID NO: 207905 - DNA, 25 bp, E. coli
gaatctgaacatggcattatctgtg

SEQ ID NO: 207906 - DNA, 25 bp, E. coli
gaatctgaacatcgcattatctgtg

SEQ ID NO: 207907 - DNA, 25 bp, E. coli
gaaatgcccattaaactgcctgaag

SEQ ID NO: 207908 - DNA, 25 bp, E. coli
gaaatgcccatttaactgcctgaag

SEQ ID NO: 207909 - DNA, 25 bp, E. coli
cctgcgtcagcgagtttagcaactg

SEQ ID NO: 207910 - DNA, 25 bp, E. coli
cctgcgtcagcgtgtttagcaactg

SEQ ID NO: 207911 - DNA, 25 bp, E. coli
gatgctatgctgaccaaaccatgtt

SEQ ID NO: 207912 - DNA, 25 bp, E. coli
gatgctatgctgtccaaaccatgtt

SEQ ID NO: 207913 - DNA, 25 bp, E. coli
aagatgtcctgattcgtcgctgtga

SEQ ID NO: 207914 - DNA, 25 bp, E. coli
catacgttgtcaccacgaccactgg

SEQ ID NO: 207915 - DNA, 25 bp, E. coli
aagaatgtgaaatctggcacgctcg

SEQ ID NO: 207916 - DNA, 25 bp, E. coli
catacgttgtcagcacgaccactgg

SEQ ID NO: 207917 - DNA, 25 bp, E. coli
aagatgtcctgaatcgtcgctgtga

SEQ ID NO: 207918 - DNA, 25 bp, E. coli
aagaatgtgaaaactggcacgctcg

SEQ ID NO: 207919 - DNA, 25 bp, E. coli
aaatcagttgcgacagccagatagc

SEQ ID NO: 207920 - DNA, 25 bp, E. coli
aaatcagttgcgtcagccagatagc

SEQ ID NO: 207921 - DNA, 25 bp, E. coli
ttggaatcaaccgtggcaacctggg

SEQ ID NO: 207922 - DNA, 25 bp, E. coli
ttggaatcaaccctggcaacctggg

SEQ ID NO: 207923 - DNA, 25 bp, E. coli
tcgccgtaacgagctggaaatcagt

SEQ ID NO: 207924 - DNA, 25 bp, E. coli
tcgccgtaacgacctggaaatcagt

SEQ ID NO: 207925 - DNA, 25 bp, E. coli
tctggatgcgataaccctggtgccc

SEQ ID NO: 207926 - DNA, 25 bp, E. coli
tctggatgcgattaccctggtgccc

SEQ ID NO: 207927 - DNA, 25 bp, E. coli
gcaacctgggttacctgactgacct

SEQ ID NO: 207928 - DNA, 25 bp, E. coli
gcaacctgggtttcctgactgacct

SEQ ID NO: 207929 - DNA, 25 bp, E. coli
cattaagcaccaagctcggctggtc

SEQ ID NO: 207930 - DNA, 25 bp, E. coli
cattaagcaccatgctcggctggtc

SEQ ID NO: 207931 - DNA, 25 bp, E. coli
tggaagcgcaagtctgtcagcaaga

SEQ ID NO: 207932 - DNA, 25 bp, E. coli
tggaagcgcaagactgtcagcaaga

SEQ ID NO: 207933 - DNA, 25 bp, E. coli
gagaaacgttttatgctggaagcgc

SEQ ID NO: 207934 - DNA, 25 bp, E. coli
gagaaacgttttttgctggaagcgc

SEQ ID NO: 207935 - DNA, 25 bp, E. coli
aatacttcgagttaccaggcagtgg

SEQ ID NO: 207936 - DNA, 25 bp, E. coli
aatacttcgagtaaccaggcagtgg

SEQ ID NO: 207937 - DNA, 25 bp, E. coli
catgacggcgggtttcaaattttgc

SEQ ID NO: 207938 - DNA, 25 bp, E. coli
catgacggcgggattcaaattttgc

SEQ ID NO: 207939 - DNA, 25 bp, E. coli
taggttacgctcaaaacattaggca

SEQ ID NO: 207940 - DNA, 25 bp, E. coli
tatggtctgacgcaaaactcctgga

SEQ ID NO: 207941 - DNA, 25 bp, E. coli
taggcatagcctattgacaatcaat

SEQ ID NO: 207942 - DNA, 25 bp, E. coli
taggttacgctctaaacattaggca

SEQ ID NO: 207943 - DNA, 25 bp, E. coli
taggcatagccttttgacaatcaat

SEQ ID NO: 207944 - DNA, 25 bp, E. coli
tatggtctgacggaaaactcctgga

SEQ ID NO: 207945 - DNA, 25 bp, E. coli
ttgacaatcaataaggcattaccta

SEQ ID NO: 207946 - DNA, 25 bp, E. coli
ttgacaatcaattaggcattaccta

SEQ ID NO: 207947 - DNA, 25 bp, E. coli
tgctgtcgccatgacctattaggtt

SEQ ID NO: 207948 - DNA, 25 bp, E. coli
tgctgtcgccatcacctattaggtt

SEQ ID NO: 207949 - DNA, 25 bp, E. coli
gaacgccgggcaatacttcgagtta

SEQ ID NO: 207950 - DNA, 25 bp, E. coli
gaacgccgggcattacttcgagtta

SEQ ID NO: 207951 - DNA, 25 bp, E. coli
cccgaggcgtatgaacatgacggcg

SEQ ID NO: 207952 - DNA, 25 bp, E. coli
cccgaggcgtatcaacatgacggcg

SEQ ID NO: 207953 - DNA, 25 bp, E. coli
gttaagtagccaccccgaggcgtat

SEQ ID NO: 207954 - DNA, 25 bp, E. coli
gttaagtagccagcccgaggcgtat

SEQ ID NO: 207955 - DNA, 25 bp, E. coli
ggcattacctatagttccagcatac

SEQ ID NO: 207956 - DNA, 25 bp, E. coli
ggcattacctattgttccagcatac

SEQ ID NO: 207957 - DNA, 25 bp, E. coli
cagtgcatggatctcgagaaagtgc

SEQ ID NO: 207958 - DNA, 25 bp, E. coli
cagtgcatggatgtcgagaaagtgc

SEQ ID NO: 207959 - DNA, 25 bp, E. coli
taaaagctgtatgctggcttgcccg

SEQ ID NO: 207960 - DNA, 25 bp, E. coli
taaaagctgtatcctggcttgcccg

SEQ ID NO: 207961 - DNA, 25 bp, E. coli
tttcttcgcgcataaaggcgagggc

SEQ ID NO: 207962 - DNA, 25 bp, E. coli
tttcttcgcgcaaaaaggcgagggc

SEQ ID NO: 207963 - DNA, 25 bp, E. coli
tgtgttgaagccagcccgacaaagg

SEQ ID NO: 207964 - DNA, 25 bp, E. coli
tgtgttgaagcctgcccgacaaagg

SEQ ID NO: 207965 - DNA, 25 bp, E. coli
tctgccctgttgacgcgataagccg

SEQ ID NO: 207966 - DNA, 25 bp, E. coli
tctgccctgttgtcgcgataagccg

SEQ ID NO: 207967 - DNA, 25 bp, E. coli
gcgataagccgccaacatgggcata

SEQ ID NO: 207968 - DNA, 25 bp, E. coli
gcgataagccgcgaacatgggcata

SEQ ID NO: 207969 - DNA, 25 bp, E. coli
cgacaaaggcgttgcagtgcatgga

SEQ ID NO: 207970 - DNA, 25 bp, E. coli
cgattaagtgcgatctgtgctggca

SEQ ID NO: 207971 - DNA, 25 bp, E. coli
cgacaaaggcgtagcagtgcatgga

SEQ ID NO: 207972 - DNA, 25 bp, E. coli
cgattaagtgcgttctgtgctggca

SEQ ID NO: 207973 - DNA, 25 bp, E. coli
cgtgcgcgaatgactgccctgttga

SEQ ID NO: 207974 - DNA, 25 bp, E. coli
cgtgcgcgaatgtctgccctgttga

SEQ ID NO: 207975 - DNA, 25 bp, E. coli
ggcagtagcctgtcatcagtgtgaa

SEQ ID NO: 207976 - DNA, 25 bp, E. coli
ggcagtagcctgacatcagtgtgaa

SEQ ID NO: 207977 - DNA, 25 bp, E. coli
gatggaggtcgtatcttcgcgcaaa

SEQ ID NO: 207978 - DNA, 25 bp, E. coli
gatggaggtcgtttcttcgcgcaaa

SEQ ID NO: 207979 - DNA, 25 bp, E. coli
aagggcatttgctccagttctggca

SEQ ID NO: 207980 - DNA, 25 bp, E. coli
aagggcatttgcaccagttctggca

SEQ ID NO: 207981 - DNA, 25 bp, E. coli
tactggcgcaagcaactttacaagg

SEQ ID NO: 207982 - DNA, 25 bp, E. coli
tactcattttcacgtaaagcgccga

SEQ ID NO: 207983 - DNA, 25 bp, E. coli
tactggcgcaaggaactttacaagg

SEQ ID NO: 207984 - DNA, 25 bp, E. coli
tactcattttcaggtaaagcgccga

SEQ ID NO: 207985 - DNA, 25 bp, E. coli
tacgggctctccaccggcaatatga

SEQ ID NO: 207986 - DNA, 25 bp, E. coli
tacgggctctcctccggcaatatga

SEQ ID NO: 207987 - DNA, 25 bp, E. coli
tacctgatgggcaggcattaccgtc

SEQ ID NO: 207988 - DNA, 25 bp, E. coli
tagtgacgattatcagtacggcggg

SEQ ID NO: 207989 - DNA, 25 bp, E. coli
tacctgatgggctggcattaccgtc

SEQ ID NO: 207990 - DNA, 25 bp, E. coli
tagtgacgattaacagtacggcggg

SEQ ID NO: 207991 - DNA, 25 bp, E. coli
tttacaaggtaacacagcgcaaggt

SEQ ID NO: 207992 - DNA, 25 bp, E. coli
tttacaaggtaagacagcgcaaggt

SEQ ID NO: 207993 - DNA, 25 bp, E. coli
tgggcaatgccctgtacgacatcaa

SEQ ID NO: 207994 - DNA, 25 bp, E. coli
tgggcaatgcccagtacgacatcaa

SEQ ID NO: 207995 - DNA, 25 bp, E. coli
tgctattgcagggaccgatgggacc

SEQ ID NO: 207996 - DNA, 25 bp, E. coli
tgctattgcaggcaccgatgggacc

SEQ ID NO: 207997 - DNA, 25 bp, E. coli
tgcgccgcacgtagagaacttaaaa

SEQ ID NO: 207998 - DNA, 25 bp, E. coli
tgcgccgcacgttgagaacttaaaa

SEQ ID NO: 207999 - DNA, 25 bp, E. coli
cgctgggcaaagacgaaagggatcc

SEQ ID NO: 208000 - DNA, 25 bp, E. coli
cgctgggcaaagtcgaaagggatcc

SEQ ID NO: 208001 - DNA, 25 bp, E. coli
cacgttccgggaactgacagcgaaa

SEQ ID NO: 208002 - DNA, 25 bp, E. coli
cacgttccgggatctgacagcgaaa

SEQ ID NO: 208003 - DNA, 25 bp, E. coli
cagattggacagataagcgagcgcg

SEQ ID NO: 208004 - DNA, 25 bp, E. coli
cagattggacagttaagcgagcgcg

SEQ ID NO: 208005 - DNA, 25 bp, E. coli
cagtattgacgctgaagcagaagcc

SEQ ID NO: 208006 - DNA, 25 bp, E. coli
cattgaaggtcccttgtcaccccgt

SEQ ID NO: 208007 - DNA, 25 bp, E. coli
cattgaaggtccgttgtcaccccgt

SEQ ID NO: 208008 - DNA, 25 bp, E. coli
cagtattgacgcagaagcagaagcc

SEQ ID NO: 208009 - DNA, 25 bp, E. coli
aaaacggcagttaccgaggcagccg

SEQ ID NO: 208010 - DNA, 25 bp, E. coli
aaaacggcagtttccgaggcagccg

SEQ ID NO: 208011 - DNA, 25 bp, E. coli
tgatggaggcaatccgggaagcact

SEQ ID NO: 208012 - DNA, 25 bp, E. coli
tgatggaggcaaaccgggaagcact

SEQ ID NO: 208013 - DNA, 25 bp, E. coli
tcaggcgcagtgacgggatcagatt

SEQ ID NO: 208014 - DNA, 25 bp, E. coli
tctgccgtttggagagacccgtgaa

SEQ ID NO: 208015 - DNA, 25 bp, E. coli
tcaggcgcagtgtcgggatcagatt

SEQ ID NO: 208016 - DNA, 25 bp, E. coli
tctgccgtttggtgagacccgtgaa

SEQ ID NO: 208017 - DNA, 25 bp, E. coli
cgcgtggtggagacaaacaatggcc

SEQ ID NO: 208018 - DNA, 25 bp, E. coli
cgcgtggtggagtcaaacaatggcc

SEQ ID NO: 208019 - DNA, 25 bp, E. coli
gattgccgcagtcggagacattgaa

SEQ ID NO: 208020 - DNA, 25 bp, E. coli
gattgccgcagtgggagacattgaa

SEQ ID NO: 208021 - DNA, 25 bp, E. coli
gatgctgatagcctctccgtcgtta

SEQ ID NO: 208022 - DNA, 25 bp, E. coli
gatgctgatagcgtctccgtcgtta

SEQ ID NO: 208023 - DNA, 25 bp, E. coli
cacgcccaaaggacctggcaaaagc

SEQ ID NO: 208024 - DNA, 25 bp, E. coli
cacgcccaaaggtcctggcaaaagc

SEQ ID NO: 208025 - DNA, 25 bp, E. coli
aaccgactacaaactggacgaccag

SEQ ID NO: 208026 - DNA, 25 bp, E. coli
aaccgactacaatctggacgaccag

SEQ ID NO: 208027 - DNA, 25 bp, E. coli
taccgctggctgctcttgtgctcac

SEQ ID NO: 208028 - DNA, 25 bp, E. coli
tatggtggttatgacaccaaaacgc

SEQ ID NO: 208029 - DNA, 25 bp, E. coli
taccgctggctggtcttgtgctcac

SEQ ID NO: 208030 - DNA, 25 bp, E. coli
tatggtggttatcacaccaaaacgc

SEQ ID NO: 208031 - DNA, 25 bp, E. coli
gcccgctttttcaggcagcaaaccg

SEQ ID NO: 208032 - DNA, 25 bp, E. coli
gcctgctaccgctggctgctcttgt

SEQ ID NO: 208033 - DNA, 25 bp, E. coli
gcccgctttttctggcagcaaaccg

SEQ ID NO: 208034 - DNA, 25 bp, E. coli
gcctgctaccgcaggctgctcttgt

SEQ ID NO: 208035 - DNA, 25 bp, E. coli
gctcactgcctgatccgttaccacg

SEQ ID NO: 208036 - DNA, 25 bp, E. coli
gctcactgcctgttccgttaccacg

SEQ ID NO: 208037 - DNA, 25 bp, E. coli
gttaccacgccctaaggtcctggca

SEQ ID NO: 208038 - DNA, 25 bp, E. coli
ggtgatgcaaccgactacaaactgg

SEQ ID NO: 208039 - DNA, 25 bp, E. coli
ggtgatgcaacccactacaaactgg

SEQ ID NO: 208040 - DNA, 25 bp, E. coli
ggctgctcttgtgctcactgcctgt

SEQ ID NO: 208041 - DNA, 25 bp, E. coli
ggctgctcttgtcctcactgcctgt

SEQ ID NO: 208042 - DNA, 25 bp, E. coli
gatgcaaccgacaacaaactggacg

SEQ ID NO: 208043 - DNA, 25 bp, E. coli
gatgcaaccgactacaaactggacg

SEQ ID NO: 208044 - DNA, 25 bp, E. coli
gttaccacgcccaaaggtcctggca

SEQ ID NO: 208045 - DNA, 25 bp, E. coli
tatccgggtaatgataacccttgag

SEQ ID NO: 208046 - DNA, 25 bp, E. coli
tatccgggtaatcataacccttgag

SEQ ID NO: 208047 - DNA, 25 bp, E. coli
ttgcggaggtgggatcccactgaat

SEQ ID NO: 208048 - DNA, 25 bp, E. coli
ttgcggaggtggcatcccactgaat

SEQ ID NO: 208049 - DNA, 25 bp, E. coli
gcgcgctggatatccgggtaatcat

SEQ ID NO: 208050 - DNA, 25 bp, E. coli
gcgcgctggataaccgggtaatcat

SEQ ID NO: 208051 - DNA, 25 bp, E. coli
gcatcccactgattcaacggcgcat

SEQ ID NO: 208052 - DNA, 25 bp, E. coli
gcatcccactgaatcaacggcgcat

SEQ ID NO: 208053 - DNA, 25 bp, E. coli
cgcgctggatatgcgggtaatcata

SEQ ID NO: 208054 - DNA, 25 bp, E. coli
cgcgctggatatccgggtaatcata

SEQ ID NO: 208055 - DNA, 25 bp, E. coli
cggaggtggcatgccactgaatcaa

SEQ ID NO: 208056 - DNA, 25 bp, E. coli
cggaggtggcatcccactgaatcaa

SEQ ID NO: 208057 - DNA, 25 bp, E. coli
gatatccgggtaatcataacccttg

SEQ ID NO: 208058 - DNA, 25 bp, E. coli
gatatccgggtattcataacccttg

SEQ ID NO: 208059 - DNA, 25 bp, E. coli
gtggcatcccacagaatcaacggcg

SEQ ID NO: 208060 - DNA, 25 bp, E. coli
gggtaatcataacccttgagattca

SEQ ID NO: 208061 - DNA, 25 bp, E. coli
gggtaatcataagccttgagattca

SEQ ID NO: 208062 - DNA, 25 bp, E. coli
gtggcatcccactgaatcaacggcg

SEQ ID NO: 208063 - DNA, 25 bp, E. coli
tggatatccgggtaatcataaccct

SEQ ID NO: 208064 - DNA, 25 bp, E. coli
tggatatccgggaaatcataaccct

SEQ ID NO: 208065 - DNA, 25 bp, E. coli
gaggtggcatccgactgaatcaacg

SEQ ID NO: 208066 - DNA, 25 bp, E. coli
gaggtggcatcccactgaatcaacg

SEQ ID NO: 208067 - DNA, 25 bp, E. coli
aagccgaagccggtcgtagtaaagc

SEQ ID NO: 208068 - DNA, 25 bp, E. coli
taaagcgcaggctctactgaaagaa

SEQ ID NO: 208069 - DNA, 25 bp, E. coli
taaagcgcaggcactactgaaagaa

SEQ ID NO: 208070 - DNA, 25 bp, E. coli
acagcggcagcgctgggtattttta

SEQ ID NO: 208071 - DNA, 25 bp, E. coli
acagcggcagcggtgggtattttta

SEQ ID NO: 208072 - DNA, 25 bp, E. coli
agcggcagcggtgggtatttttatc

SEQ ID NO: 208073 - DNA, 25 bp, E. coli
agcggcagcggtcggtatttttatc

SEQ ID NO: 208074 - DNA, 25 bp, E. coli
aagccgaagccgctcgtagtaaagc

SEQ ID NO: 208075 - DNA, 25 bp, E. coli
gccgctcgtagtaaagcgcaggctc

SEQ ID NO: 208076 - DNA, 25 bp, E. coli
gcgcaggctctagtgaaagaaacca

SEQ ID NO: 208077 - DNA, 25 bp, E. coli
gccgctcgtagttaagcgcaggctc

SEQ ID NO: 208078 - DNA, 25 bp, E. coli
gcgcaggctctactgaaagaaacca

SEQ ID NO: 208079 - DNA, 25 bp, E. coli
gctcgtagtaaagcgcaggctctac

SEQ ID NO: 208080 - DNA, 25 bp, E. coli
gctcgtagtaaaccgcaggctctac

SEQ ID NO: 208081 - DNA, 25 bp, E. coli
gaagccgctcgtagtaaagcgcagg

SEQ ID NO: 208082 - DNA, 25 bp, E. coli
gcaggctctactcaaagaaaccagg

SEQ ID NO: 208083 - DNA, 25 bp, E. coli
gaagccgctcgttgtaaagcgcagg

SEQ ID NO: 208084 - DNA, 25 bp, E. coli
gcaggctctactgaaagaaaccagg

SEQ ID NO: 208085 - DNA, 25 bp, E. coli
cgtagtaaagcgcaggctctactga

SEQ ID NO: 208086 - DNA, 25 bp, E. coli
ctggtgtagtgtcggtacagcggca

SEQ ID NO: 208087 - DNA, 25 bp, E. coli
cgtagtaaagcggaggctctactga

SEQ ID NO: 208088 - DNA, 25 bp, E. coli
ctggtgtagtgtgggtacagcggca

SEQ ID NO: 208089 - DNA, 25 bp, E. coli
catggacgctttagccagggctggt

SEQ ID NO: 208090 - DNA, 25 bp, E. coli
catggacgcttttgccagggctggt

SEQ ID NO: 208091 - DNA, 25 bp, E. coli
aaaggctaccttcggcttgccctga

SEQ ID NO: 208092 - DNA, 25 bp, E. coli
aaaggctaccttgggcttgccctga

SEQ ID NO: 208093 - DNA, 25 bp, E. coli
tgtttcgaagcacgagaatttctcg

SEQ ID NO: 208094 - DNA, 25 bp, E. coli
tgtttcgaagcaggagaatttctcg

SEQ ID NO: 208095 - DNA, 25 bp, E. coli
tctcgaaactggagatgaggccgcg

SEQ ID NO: 208096 - DNA, 25 bp, E. coli
tctacatggacggtttagccagggc

SEQ ID NO: 208097 - DNA, 25 bp, E. coli
tctcgaaactggtgatgaggccgcg

SEQ ID NO: 208098 - DNA, 25 bp, E. coli
tctacatggacgctttagccagggc

SEQ ID NO: 208099 - DNA, 25 bp, E. coli
ccagggctggtaattctgtttcgaa

SEQ ID NO: 208100 - DNA, 25 bp, E. coli
ccagggctggtatttctgtttcgaa

SEQ ID NO: 208101 - DNA, 25 bp, E. coli
gcttagctggtatcgcaccttttat

SEQ ID NO: 208102 - DNA, 25 bp, E. coli
gcttagctggtaacgcaccttttat

SEQ ID NO: 208103 - DNA, 25 bp, E. coli
gaaattcattctctgggaacggcaa

SEQ ID NO: 208104 - DNA, 25 bp, E. coli
gaaattcattctgtgggaacggcaa

SEQ ID NO: 208105 - DNA, 25 bp, E. coli
cccggtcgtcataactctacatgga

SEQ ID NO: 208106 - DNA, 25 bp, E. coli
cccggtcgtcattactctacatgga

SEQ ID NO: 208107 - DNA, 25 bp, E. coli
gattacttatcaggacgcattcgcg

SEQ ID NO: 208108 - DNA, 25 bp, E. coli
gattacttatcacgacgcattcgcg

SEQ ID NO: 208109 - DNA, 25 bp, E. coli
ggccgcgcgctttgctggtaacgca

SEQ ID NO: 208110 - DNA, 25 bp, E. coli
ggccgcgcgcttagctggtaacgca

SEQ ID NO: 208111 - DNA, 25 bp, E. coli
aatgagaaatcacagagcaacggtc

SEQ ID NO: 208112 - DNA, 25 bp, E. coli
aatgagaaatcagagagcaacggtc

SEQ ID NO: 208113 - DNA, 25 bp, E. coli
catattgggtgaccatgaaatgaga

SEQ ID NO: 208114 - DNA, 25 bp, E. coli
cagttgtagttaatatcgcaagaag

SEQ ID NO: 208115 - DNA, 25 bp, E. coli
catattgggtgagcatgaaatgaga

SEQ ID NO: 208116 - DNA, 25 bp, E. coli
cataacatcgtacgttctcagtgaa

SEQ ID NO: 208117 - DNA, 25 bp, E. coli
cagttgtagttattatcgcaagaag

SEQ ID NO: 208118 - DNA, 25 bp, E. coli
cataacatcgtaggttctcagtgaa

SEQ ID NO: 208119 - DNA, 25 bp, E. coli
taacagttttagtaaacgccgccat

SEQ ID NO: 208120 - DNA, 25 bp, E. coli
tgtaaatacagcgataacatcgtag

SEQ ID NO: 208121 - DNA, 25 bp, E. coli
tgtaaatacagccataacatcgtag

SEQ ID NO: 208122 - DNA, 25 bp, E. coli
tcttatataccacaaagagatgtca

SEQ ID NO: 208123 - DNA, 25 bp, E. coli
tcttatataccagaaagagatgtca

SEQ ID NO: 208124 - DNA, 25 bp, E. coli
tcagtgaaccatattcaggataact

SEQ ID NO: 208125 - DNA, 25 bp, E. coli
tcagtgaaccattttcaggataact

SEQ ID NO: 208126 - DNA, 25 bp, E. coli
gaaaacgccgccttcatattgggtg

SEQ ID NO: 208127 - DNA, 25 bp, E. coli
gaaaacgccgccatcatattgggtg

SEQ ID NO: 208128 - DNA, 25 bp, E. coli
ggaatatgcttcgtgtcgcagagaa

SEQ ID NO: 208129 - DNA, 25 bp, E. coli
ggaatatgcttcctgtcgcagagaa

SEQ ID NO: 208130 - DNA, 25 bp, E. coli
taacagttttagaaaacgccgccat

SEQ ID NO: 208131 - DNA, 25 bp, E. coli
gagcaacggtcattttgaaagggtt

SEQ ID NO: 208132 - DNA, 25 bp, E. coli
gagcaacggtcaatttgaaagggtt

SEQ ID NO: 208133 - DNA, 25 bp, E. coli
tacaacattcagcacgaaaccgggc

SEQ ID NO: 208134 - DNA, 25 bp, E. coli
tacaacattcaggacgaaaccgggc

SEQ ID NO: 208135 - DNA, 25 bp, E. coli
aaagatttgacccatctgccagcgc

SEQ ID NO: 208136 - DNA, 25 bp, E. coli
aaagattctcgctggtttataccgc

SEQ ID NO: 208137 - DNA, 25 bp, E. coli
aaagatttgaccgatctgccagcgc

SEQ ID NO: 208138 - DNA, 25 bp, E. coli
aaagattctcgcaggtttataccgc

SEQ ID NO: 208139 - DNA, 25 bp, E. coli
tatgtcggttcctccggaatcctga

SEQ ID NO: 208140 - DNA, 25 bp, E. coli
tatgtcggttccaccggaatcctga

SEQ ID NO: 208141 - DNA, 25 bp, E. coli
tttataccgctggagcgccagggct

SEQ ID NO: 208142 - DNA, 25 bp, E. coli
ttactgagcggaagcttaaccgccc

SEQ ID NO: 208143 - DNA, 25 bp, E. coli
tttataccgctgcagcgccagggct

SEQ ID NO: 208144 - DNA, 25 bp, E. coli
ttactgagcggatgcttaaccgccc

SEQ ID NO: 208145 - DNA, 25 bp, E. coli
tgccattaataaccgaatcccgctg

SEQ ID NO: 208146 - DNA, 25 bp, E. coli
tgccattaataagcgaatcccgctg

SEQ ID NO: 208147 - DNA, 25 bp, E. coli
tgcggcacaagaaaacggcacggtt

SEQ ID NO: 208148 - DNA, 25 bp, E. coli
tgcggcacaagataacggcacggtt

SEQ ID NO: 208149 - DNA, 25 bp, E. coli
gaagccgccagagcgacattaatgc

SEQ ID NO: 208150 - DNA, 25 bp, E. coli
gaatgacattctggtgaaataccgc

SEQ ID NO: 208151 - DNA, 25 bp, E. coli
gaatgacattctcgtgaaataccgc

SEQ ID NO: 208152 - DNA, 25 bp, E. coli
gaagccgccagaccgacattaatgc

SEQ ID NO: 208153 - DNA, 25 bp, E. coli
cgtgctcagagcaacaaagatttga

SEQ ID NO: 208154 - DNA, 25 bp, E. coli
cgtgctcagagctacaaagatttga

SEQ ID NO: 208155 - DNA, 25 bp, E. coli
atgagtgtgcgtttgcgcccaggca

SEQ ID NO: 208156 - DNA, 25 bp, E. coli
atgagtgtgcgtatgcgcccaggca

SEQ ID NO: 208157 - DNA, 25 bp, E. coli
tacgctggcgacttccagtagcagg

SEQ ID NO: 208158 - DNA, 25 bp, E. coli
tacgctggcgacatccagtagcagg

SEQ ID NO: 208159 - DNA, 25 bp, E. coli
ttaacattgcgccagcccacttgca

SEQ ID NO: 208160 - DNA, 25 bp, E. coli
ttaacattgcgcgagcccacttgca

SEQ ID NO: 208161 - DNA, 25 bp, E. coli
tcgtacgtttgtcctggtaaaagat

SEQ ID NO: 208162 - DNA, 25 bp, E. coli
ttcgttggacttgtctgctattacc

SEQ ID NO: 208163 - DNA, 25 bp, E. coli
ttcgttggacttctctgctattacc

SEQ ID NO: 208164 - DNA, 25 bp, E. coli
tcgtacgtttgtgctggtaaaagat

SEQ ID NO: 208165 - DNA, 25 bp, E. coli
cctgatgagtgtgcgtatgcgccca

SEQ ID NO: 208166 - DNA, 25 bp, E. coli
cctgatgagtgtccgtatgcgccca

SEQ ID NO: 208167 - DNA, 25 bp, E. coli
gaatgttcgtacctttgtgctggta

SEQ ID NO: 208168 - DNA, 25 bp, E. coli
gaatgttcgtacgtttgtgctggta

SEQ ID NO: 208169 - DNA, 25 bp, E. coli
gaactttcgttgcacttctctgcta

SEQ ID NO: 208170 - DNA, 25 bp, E. coli
gaactttcgttggacttctctgcta

SEQ ID NO: 208171 - DNA, 25 bp, E. coli
gacatccagtagcaggtgaaatccc

SEQ ID NO: 208172 - DNA, 25 bp, E. coli
gacatccagtaggaggtgaaatccc

SEQ ID NO: 208173 - DNA, 25 bp, E. coli
tggcatgagtggaactttcgttgga

SEQ ID NO: 208174 - DNA, 25 bp, E. coli
tggcatgagtggtactttcgttgga

SEQ ID NO: 208175 - DNA, 25 bp, E. coli
gatggcctagccgtcattattggta

SEQ ID NO: 208176 - DNA, 25 bp, E. coli
gatggcctagccctcattattggta

SEQ ID NO: 208177 - DNA, 25 bp, E. coli
aattagaagggctaagcgatctcgg

SEQ ID NO: 208178 - DNA, 25 bp, E. coli
aattagaagggcaaagcgatctcgg

SEQ ID NO: 208179 - DNA, 25 bp, E. coli
taaaggttcaatcgctatggccgcc

SEQ ID NO: 208180 - DNA, 25 bp, E. coli
taaaggttcaatggctatggccgcc

SEQ ID NO: 208181 - DNA, 25 bp, E. coli
tatcaatacggtttgtcggcccgcg

SEQ ID NO: 208182 - DNA, 25 bp, E. coli
tatcgtctgtactggagtgcgcaac

SEQ ID NO: 208183 - DNA, 25 bp, E. coli
tatcaatacggtatgtcggcccgcg

SEQ ID NO: 208184 - DNA, 25 bp, E. coli
tatcgtctgtacaggagtgcgcaac

SEQ ID NO: 208185 - DNA, 25 bp, E. coli
tgatggaaatcccaacaacgggcga

SEQ ID NO: 208186 - DNA, 25 bp, E. coli
tgttcattgcccattagcgcgcgtt

SEQ ID NO: 208187 - DNA, 25 bp, E. coli
tgatggaaatccgaacaacgggcga

SEQ ID NO: 208188 - DNA, 25 bp, E. coli
tgttcattgccctttagcgcgcgtt

SEQ ID NO: 208189 - DNA, 25 bp, E. coli
tctgatcgtctgaccatgtggcggg

SEQ ID NO: 208190 - DNA, 25 bp, E. coli
tctgatcgtctgtccatgtggcggg

SEQ ID NO: 208191 - DNA, 25 bp, E. coli
ccaagtctgtgggtggaaccgcgta

SEQ ID NO: 208192 - DNA, 25 bp, E. coli
ccaagtctgtggctggaaccgcgta

SEQ ID NO: 208193 - DNA, 25 bp, E. coli
tggaaaatcaccagtatgcgcgcaa

SEQ ID NO: 208194 - DNA, 25 bp, E. coli
tggaaaatcacctgtatgcgcgcaa

SEQ ID NO: 208195 - DNA, 25 bp, E. coli
tcagctgcggtagtaatgaacgtcg

SEQ ID NO: 208196 - DNA, 25 bp, E. coli
tcagctgcggtactaatgaacgtcg

SEQ ID NO: 208197 - DNA, 25 bp, E. coli
gacgccgcaggcttataacagtatt

SEQ ID NO: 208198 - DNA, 25 bp, E. coli
gacgccgcaggcatataacagtatt

SEQ ID NO: 208199 - DNA, 25 bp, E. coli
cagcttcgggcgtatctgggatcag

SEQ ID NO: 208200 - DNA, 25 bp, E. coli
cagcttcgggcgaatctgggatcag

SEQ ID NO: 208201 - DNA, 25 bp, E. coli
tatctgggatcactacggcatgctg

SEQ ID NO: 208202 - DNA, 25 bp, E. coli
tatctgggatcagtacggcatgctg

SEQ ID NO: 208203 - DNA, 25 bp, E. coli
tttctgtcgcctccgtaattgcctg

SEQ ID NO: 208204 - DNA, 25 bp, E. coli
tttctgtcgcctgcgtaattgcctg

SEQ ID NO: 208205 - DNA, 25 bp, E. coli
tgggcctggcaaattccatgtcggg

SEQ ID NO: 208206 - DNA, 25 bp, E. coli
tgggcctggcaatttccatgtcggg

SEQ ID NO: 208207 - DNA, 25 bp, E. coli
tgatgtcttctgtttctacatcggg

SEQ ID NO: 208208 - DNA, 25 bp, E. coli
tgatgtcttctgattctacatcggg

SEQ ID NO: 208209 - DNA, 25 bp, E. coli
tcagtacggcatgctggtggtgttt

SEQ ID NO: 208210 - DNA, 25 bp, E. coli
tctggcgcaccttagtcgtcattca

SEQ ID NO: 208211 - DNA, 25 bp, E. coli
tcagtacggcatcctggtggtgttt

SEQ ID NO: 208212 - DNA, 25 bp, E. coli
tctggcgcacctaagtcgtcattca

SEQ ID NO: 208213 - DNA, 25 bp, E. coli
gcttccggtgacattgacctttctg

SEQ ID NO: 208214 - DNA, 25 bp, E. coli
gcttccggtgactttgacctttctg

SEQ ID NO: 208215 - DNA, 25 bp, E. coli
gactttgacctttctgtcgcctccg

SEQ ID NO: 208216 - DNA, 25 bp, E. coli
gactttgaccttactgtcgcctccg

SEQ ID NO: 208217 - DNA, 25 bp, E. coli
taagtcgtcattcagcttcgggcgt

SEQ ID NO: 208218 - DNA, 25 bp, E. coli
taatatgaaagggttgggcctggca

SEQ ID NO: 208219 - DNA, 25 bp, E. coli
taagtcgtcattgagcttcgggcgt

SEQ ID NO: 208220 - DNA, 25 bp, E. coli
taatatgaaaggcttgggcctggca

SEQ ID NO: 208221 - DNA, 25 bp, E. coli
catgtggttattgccaacgaggtca

SEQ ID NO: 208222 - DNA, 25 bp, E. coli
catggaacaagaatgcctgctggca

SEQ ID NO: 208223 - DNA, 25 bp, E. coli
catggaacaagattgcctgctggca

SEQ ID NO: 208224 - DNA, 25 bp, E. coli
catgtggttattcccaacgaggtca

SEQ ID NO: 208225 - DNA, 25 bp, E. coli
tattcttgggctcaatgccgcgggc

SEQ ID NO: 208226 - DNA, 25 bp, E. coli
tttgaaggctcgctggttgaaccgc

SEQ ID NO: 208227 - DNA, 25 bp, E. coli
tattcttgggctgaatgccgcgggc

SEQ ID NO: 208228 - DNA, 25 bp, E. coli
ttgaagagaaaaaagtgcaggccgc

SEQ ID NO: 208229 - DNA, 25 bp, E. coli
tttgaaggctcggtggttgaaccgc

SEQ ID NO: 208230 - DNA, 25 bp, E. coli
ttgaagagaaaatagtgcaggccgc

SEQ ID NO: 208231 - DNA, 25 bp, E. coli
tgcaggccgcaatagtggtaacaca

SEQ ID NO: 208232 - DNA, 25 bp, E. coli
tgcaggccgcaaaagtggtaacaca

SEQ ID NO: 208233 - DNA, 25 bp, E. coli
tcttcctggaaacaggccaatctgg

SEQ ID NO: 208234 - DNA, 25 bp, E. coli
tcttcctggaaagaggccaatctgg

SEQ ID NO: 208235 - DNA, 25 bp, E. coli
gaaaccacgcttcaattgcctgccg

SEQ ID NO: 208236 - DNA, 25 bp, E. coli
gaaaccacgcttgaattgcctgccg

SEQ ID NO: 208237 - DNA, 25 bp, E. coli
gattcaggatcaagcactggcggcg

SEQ ID NO: 208238 - DNA, 25 bp, E. coli
gattcaggatcatgcactggcggcg

SEQ ID NO: 208239 - DNA, 25 bp, E. coli
tggcagcacaaattccagccgggtc

SEQ ID NO: 208240 - DNA, 25 bp, E. coli
tggcagcacaaaatccagccgggtc

SEQ ID NO: 208241 - DNA, 25 bp, E. coli
taatgaaggactggtgactctcgcc

SEQ ID NO: 208242 - DNA, 25 bp, E. coli
taatgaaggactcgtgactctcgcc

SEQ ID NO: 208243 - DNA, 25 bp, E. coli
caaacacaatcctgtcctggtgcgt

SEQ ID NO: 208244 - DNA, 25 bp, E. coli
caaacacaatccagtcctggtgcgt

SEQ ID NO: 208245 - DNA, 25 bp, E. coli
attagccggtgggagcacctgtcca

SEQ ID NO: 208246 - DNA, 25 bp, E. coli
attagccggtggcagcacctgtcca

SEQ ID NO: 208247 - DNA, 25 bp, E. coli
tgtcctggtgcgacaattacctgtt

SEQ ID NO: 208248 - DNA, 25 bp, E. coli
tgtcctggtgcgtcaattacctgtt

SEQ ID NO: 208249 - DNA, 25 bp, E. coli
tcgcagcgtcaaacacaatcctgtc

SEQ ID NO: 208250 - DNA, 25 bp, E. coli
tcgcagcgtcaatcacaatcctgtc

SEQ ID NO: 208251 - DNA, 25 bp, E. coli
tctgagcccgggtaaaaccgcgccg

SEQ ID NO: 208252 - DNA, 25 bp, E. coli
tctgagcccgggaaaaaccgcgccg

SEQ ID NO: 208253 - DNA, 25 bp, E. coli
gaatgcgatctgagcccgggtaaaa

SEQ ID NO: 208254 - DNA, 25 bp, E. coli
gaatgcgatctgtgcccgggtaaaa

SEQ ID NO: 208255 - DNA, 25 bp, E. coli
cgcgtctgacctggtagatggacta

SEQ ID NO: 208256 - DNA, 25 bp, E. coli
cgcgtctgacctcgtagatggacta

SEQ ID NO: 208257 - DNA, 25 bp, E. coli
gtctgacctggtagatggactaggc

SEQ ID NO: 208258 - DNA, 25 bp, E. coli
gtttaacgccaatggcgcgctgacg

SEQ ID NO: 208259 - DNA, 25 bp, E. coli
gtctgacctggttgatggactaggc

SEQ ID NO: 208260 - DNA, 25 bp, E. coli
gtttaacgccaaaggcgcgctgacg

SEQ ID NO: 208261 - DNA, 25 bp, E. coli
gtggcagcacctgtccagtggtcag

SEQ ID NO: 208262 - DNA, 25 bp, E. coli
gtggcagcacctctccagtggtcag

SEQ ID NO: 208263 - DNA, 25 bp, E. coli
tcaattacctgttaaaaacctgaca

SEQ ID NO: 208264 - DNA, 25 bp, E. coli
tcaattacctgtaaaaaacctgaca

SEQ ID NO: 208265 - DNA, 25 bp, E. coli
cacgacctggcgatgaactttggca

SEQ ID NO: 208266 - DNA, 25 bp, E. coli
cacgacctggcgttgaactttggca

SEQ ID NO: 208267 - DNA, 25 bp, E. coli
tacgatctgggtacgctaacgccaa

SEQ ID NO: 208268 - DNA, 25 bp, E. coli
acgtatttgaacatgctggcgcgcg

SEQ ID NO: 208269 - DNA, 25 bp, E. coli
aaagaagatgccgtgaccgtggtcg

SEQ ID NO: 208270 - DNA, 25 bp, E. coli
acgtatttgaacttgctggcgcgcg

SEQ ID NO: 208271 - DNA, 25 bp, E. coli
aaagaagatgccctgaccgtggtcg

SEQ ID NO: 208272 - DNA, 25 bp, E. coli
tacgatctgggttcgctaacgccaa

SEQ ID NO: 208273 - DNA, 25 bp, E. coli
ttgaaccggaaatagcgcgaacctg

SEQ ID NO: 208274 - DNA, 25 bp, E. coli
ttgaaccggaaaaagcgcgaacctg

SEQ ID NO: 208275 - DNA, 25 bp, E. coli
ccaatacggtgaaagagagcgccga

SEQ ID NO: 208276 - DNA, 25 bp, E. coli
ccaatacggtgatagagagcgccga

SEQ ID NO: 208277 - DNA, 25 bp, E. coli
gaaatccgcgagaaaggcgacacct

SEQ ID NO: 208278 - DNA, 25 bp, E. coli
gaaatccgcgagtaaggcgacacct

SEQ ID NO: 208279 - DNA, 25 bp, E. coli
cgaaagagacgcacaacctgatggt

SEQ ID NO: 208280 - DNA, 25 bp, E. coli
cgaaagagacgctcaacctgatggt

SEQ ID NO: 208281 - DNA, 25 bp, E. coli
gataaagcgctctatcagtatgccg

SEQ ID NO: 208282 - DNA, 25 bp, E. coli
gataaagcgctcaatcagtatgccg

SEQ ID NO: 208283 - DNA, 25 bp, E. coli
gatttccagtccagccagtttgcgg

SEQ ID NO: 208284 - DNA, 25 bp, E. coli
gatttaccctctcggttgacgccag

SEQ ID NO: 208285 - DNA, 25 bp, E. coli
gatttccagtcctgccagtttgcgg

SEQ ID NO: 208286 - DNA, 25 bp, E. coli
gatttaccctctgggttgacgccag

SEQ ID NO: 208287 - DNA, 25 bp, E. coli
caggaactttcgaaacaggaggcgc

SEQ ID NO: 208288 - DNA, 25 bp, E. coli
caggaactttcgtaacaggaggcgc

SEQ ID NO: 208289 - DNA, 25 bp, E. coli
tactgatctgctgacgcccgttaag

SEQ ID NO: 208290 - DNA, 25 bp, E. coli
tactgatctgctcacgcccgttaag

SEQ ID NO: 208291 - DNA, 25 bp, E. coli
tgtcagtaaagacgccgcaaaggca

SEQ ID NO: 208292 - DNA, 25 bp, E. coli
tgtcagtaaagaggccgcaaaggca

SEQ ID NO: 208293 - DNA, 25 bp, E. coli
tgctggagaaggaaaacgcgctgcc

SEQ ID NO: 208294 - DNA, 25 bp, E. coli
tgctggagaaggtaaacgcgctgcc

SEQ ID NO: 208295 - DNA, 25 bp, E. coli
gaagtaattgtgtgtcgcgcagcca

SEQ ID NO: 208296 - DNA, 25 bp, E. coli
gaatatggtcatgcatccgctggac

SEQ ID NO: 208297 - DNA, 25 bp, E. coli
gcaactgcccgtatagcccgtgaaa

SEQ ID NO: 208298 - DNA, 25 bp, E. coli
gaagtaattgtgagtcgcgcagcca

SEQ ID NO: 208299 - DNA, 25 bp, E. coli
gcaactgcccgtttagcccgtgaaa

SEQ ID NO: 208300 - DNA, 25 bp, E. coli
gaatatggtcatccatccgctggac

SEQ ID NO: 208301 - DNA, 25 bp, E. coli
gatcatcattcacacgcagccagga

SEQ ID NO: 208302 - DNA, 25 bp, E. coli
gatcatcattcagacgcagccagga

SEQ ID NO: 208303 - DNA, 25 bp, E. coli
tggattatcgtaaagcggcggcgct

SEQ ID NO: 208304 - DNA, 25 bp, E. coli
tggattatcgtatagcggcggcgct

SEQ ID NO: 208305 - DNA, 25 bp, E. coli
ggctccatgcagtaagaatccgaca

SEQ ID NO: 208306 - DNA, 25 bp, E. coli
ggctccatgcagaaagaatccgaca

SEQ ID NO: 208307 - DNA, 25 bp, E. coli
gatcgtattgcacgtgccggagcca

SEQ ID NO: 208308 - DNA, 25 bp, E. coli
gatcgtattgcaggtgccggagcca

SEQ ID NO: 208309 - DNA, 25 bp, E. coli
aaatcaagcatcaaatgacttgccg

SEQ ID NO: 208310 - DNA, 25 bp, E. coli
aaatcaagcatctaatgacttgccg

SEQ ID NO: 208311 - DNA, 25 bp, E. coli
tatgggcgctgtagcggctttgtca

SEQ ID NO: 208312 - DNA, 25 bp, E. coli
tatgggcgctgttgcggctttgtca

SEQ ID NO: 208313 - DNA, 25 bp, E. coli
tttcatctctccctaaagcgtttat

SEQ ID NO: 208314 - DNA, 25 bp, E. coli
tttcatctctccgtaaagcgtttat

SEQ ID NO: 208315 - DNA, 25 bp, E. coli
ttgatctgaatccaaaagcaatgac

SEQ ID NO: 208316 - DNA, 25 bp, E. coli
ttgatctgaatcgaaaagcaatgac

SEQ ID NO: 208317 - DNA, 25 bp, E. coli
tgtcactggtgaacgcacaatctgc

SEQ ID NO: 208318 - DNA, 25 bp, E. coli
tgtcactggtgatcgcacaatctgc

SEQ ID NO: 208319 - DNA, 25 bp, E. coli
tccgctaaagatttgacctgccagg

SEQ ID NO: 208320 - DNA, 25 bp, E. coli
tccgctaaagatatgacctgccagg

SEQ ID NO: 208321 - DNA, 25 bp, E. coli
gaagaaacagtaaataaaggtggcg

SEQ ID NO: 208322 - DNA, 25 bp, E. coli
gaagaaacagtatataaaggtggcg

SEQ ID NO: 208323 - DNA, 25 bp, E. coli
gaaaccgatctctctcaaattccta

SEQ ID NO: 208324 - DNA, 25 bp, E. coli
gaaaccgatctcactcaaattccta

SEQ ID NO: 208325 - DNA, 25 bp, E. coli
ggtggatgctgcatgaagaaacagt

SEQ ID NO: 208326 - DNA, 25 bp, E. coli
ggtggatgctgcttgaagaaacagt

SEQ ID NO: 208327 - DNA, 25 bp, E. coli
tggcagccaatgtatccgctaaaga

SEQ ID NO: 208328 - DNA, 25 bp, E. coli
tggcagccaatgaatccgctaaaga

SEQ ID NO: 208329 - DNA, 25 bp, E. coli
gacctgccaggattttattgatctg

SEQ ID NO: 208330 - DNA, 25 bp, E. coli
gacctgccaggaatttattgatctg

SEQ ID NO: 208331 - DNA, 25 bp, E. coli
tactggcacataaccggctgactgg

SEQ ID NO: 208332 - DNA, 25 bp, E. coli
tactggcacatatccggctgactgg

SEQ ID NO: 208333 - DNA, 25 bp, E. coli
accctgaaacgtctgtactggcaca

SEQ ID NO: 208334 - DNA, 25 bp, E. coli
accctgaaacgtgtgtactggcaca

SEQ ID NO: 208335 - DNA, 25 bp, E. coli
tatgtaatggcaaccctgaaacgtc

SEQ ID NO: 208336 - DNA, 25 bp, E. coli
tatgcaaaagaaagcgcgctggaag

SEQ ID NO: 208337 - DNA, 25 bp, E. coli
tatgtaatggcatccctgaaacgtc

SEQ ID NO: 208338 - DNA, 25 bp, E. coli
tatgcaaaagaatgcgcgctggaag

SEQ ID NO: 208339 - DNA, 25 bp, E. coli
tgttctgcctgcgacgacgaaatcg

SEQ ID NO: 208340 - DNA, 25 bp, E. coli
tgttctgcctgccacgacgaaatcg

SEQ ID NO: 208341 - DNA, 25 bp, E. coli
tgactggattgtgcggcaccggtac

SEQ ID NO: 208342 - DNA, 25 bp, E. coli
tgactggattgtccggcaccggtac

SEQ ID NO: 208343 - DNA, 25 bp, E. coli
gaatccctggcgtatgtaatggcaa

SEQ ID NO: 208344 - DNA, 25 bp, E. coli
gaatccctggcgaatgtaatggcaa

SEQ ID NO: 208345 - DNA, 25 bp, E. coli
cgctggaaggtaaggcgagaacaca

SEQ ID NO: 208346 - DNA, 25 bp, E. coli
cgctggaaggtatggcgagaacaca

SEQ ID NO: 208347 - DNA, 25 bp, E. coli
cgagaacacaggatatctggctgaa

SEQ ID NO: 208348 - DNA, 25 bp, E. coli
cgagaacacaggttatctggctgaa

SEQ ID NO: 208349 - DNA, 25 bp, E. coli
gattgccaccatagcatgttctgcc

SEQ ID NO: 208350 - DNA, 25 bp, E. coli
tggctgatttgacaaaagcagcgcg

SEQ ID NO: 208351 - DNA, 25 bp, E. coli
tggctgatttgagaaaagcagcgcg

SEQ ID NO: 208352 - DNA, 25 bp, E. coli
gattgccaccattgcatgttctgcc

SEQ ID NO: 208353 - DNA, 25 bp, E. coli
agtaaactgtcacttccggatgcgc

SEQ ID NO: 208354 - DNA, 25 bp, E. coli
cctcacccgtggtgaactccttaat

SEQ ID NO: 208355 - DNA, 25 bp, E. coli
cctcacccgtggagaactccttaat

SEQ ID NO: 208356 - DNA, 25 bp, E. coli
agtaaactgtcagttccggatgcgc

SEQ ID NO: 208357 - DNA, 25 bp, E. coli
aaatttaacgacaggctatctatga

SEQ ID NO: 208358 - DNA, 25 bp, E. coli
actaaccttagctttgttgattagc

SEQ ID NO: 208359 - DNA, 25 bp, E. coli
aaatttaacgactggctatctatga

SEQ ID NO: 208360 - DNA, 25 bp, E. coli
actaaccttagcattgttgattagc

SEQ ID NO: 208361 - DNA, 25 bp, E. coli
tgcgctttcgcgttatggtctgact

SEQ ID NO: 208362 - DNA, 25 bp, E. coli
tgcgctttcgcgatatggtctgact

SEQ ID NO: 208363 - DNA, 25 bp, E. coli
tctatgaaccaggtacctcgccatg

SEQ ID NO: 208364 - DNA, 25 bp, E. coli
tctatgaaccagctacctcgccatg

SEQ ID NO: 208365 - DNA, 25 bp, E. coli
cctcgccatgcgctttcgcgttatg

SEQ ID NO: 208366 - DNA, 25 bp, E. coli
cctcgccatgcggtttcgcgttatg

SEQ ID NO: 208367 - DNA, 25 bp, E. coli
gacgaaaatttatcgacaggctatc

SEQ ID NO: 208368 - DNA, 25 bp, E. coli
gaagcgcacggtcgacgaaaattta

SEQ ID NO: 208369 - DNA, 25 bp, E. coli
gacgaaaatttaacgacaggctatc

SEQ ID NO: 208370 - DNA, 25 bp, E. coli
gaagcgcacggtggacgaaaattta

SEQ ID NO: 208371 - DNA, 25 bp, E. coli
tggagaactccttaattactaacct

SEQ ID NO: 208372 - DNA, 25 bp, E. coli
ggctatctatgatccagctacctcg

SEQ ID NO: 208373 - DNA, 25 bp, E. coli
tggagaactcctaaattactaacct

SEQ ID NO: 208374 - DNA, 25 bp, E. coli
ggctatctatgaaccagctacctcg

SEQ ID NO: 208375 - DNA, 25 bp, E. coli
cagtacctgcaataacatggcctga

SEQ ID NO: 208376 - DNA, 25 bp, E. coli
cagtacctgcaaaaacatggcctga

SEQ ID NO: 208377 - DNA, 25 bp, E. coli
atcagtacctgcaaaaacatggcct

SEQ ID NO: 208378 - DNA, 25 bp, E. coli
accgaactatttatcagtacctgca

SEQ ID NO: 208379 - DNA, 25 bp, E. coli
agtacctgcaaatacatggcctgaa

SEQ ID NO: 208380 - DNA, 25 bp, E. coli
agtacctgcaaaaacatggcctgaa

SEQ ID NO: 208381 - DNA, 25 bp, E. coli
atcagtacctgctaaaacatggcct

SEQ ID NO: 208382 - DNA, 25 bp, E. coli
accgaactatttttcagtacctgca

SEQ ID NO: 208383 - DNA, 25 bp, E. coli
tatcagtacctggaaaaacatggcc

SEQ ID NO: 208384 - DNA, 25 bp, E. coli
tatcagtacctgcaaaaacatggcc

SEQ ID NO: 208385 - DNA, 25 bp, E. coli
tcagtacctgcataaacatggcctg

SEQ ID NO: 208386 - DNA, 25 bp, E. coli
tcagtacctgcaaaaacatggcctg

SEQ ID NO: 208387 - DNA, 25 bp, E. coli
gaactatttatcagtacctgcaaaa

SEQ ID NO: 208388 - DNA, 25 bp, E. coli
gaactatttatctgtacctgcaaaa

SEQ ID NO: 208389 - DNA, 25 bp, E. coli
ccgaactatttatcagtacctgcaa

SEQ ID NO: 208390 - DNA, 25 bp, E. coli
ccgaactatttaacagtacctgcaa

SEQ ID NO: 208391 - DNA, 25 bp, E. coli
gtacctgcaaaaacatggcctgaaa

SEQ ID NO: 208392 - DNA, 25 bp, E. coli
gtacctgcaaaatcatggcctgaaa

SEQ ID NO: 208393 - DNA, 25 bp, E. coli
taaccgaactatatatcagtacctg

SEQ ID NO: 208394 - DNA, 25 bp, E. coli
taaccgaactatttatcagtacctg

SEQ ID NO: 208395 - DNA, 25 bp, E. coli
gataaccgaactatttatcagtacc

SEQ ID NO: 208396 - DNA, 25 bp, E. coli
gataaccgaactttttatcagtacc

SEQ ID NO: 208397 - DNA, 25 bp, E. coli
aagcattgaaactcatcgaggttga

SEQ ID NO: 208398 - DNA, 25 bp, E. coli
aagcattgaaacacatcgaggttga

SEQ ID NO: 208399 - DNA, 25 bp, E. coli
cattgaaactcatcgaggttgaata

SEQ ID NO: 208400 - DNA, 25 bp, E. coli
cattgaaactcaacgaggttgaata

SEQ ID NO: 208401 - DNA, 25 bp, E. coli
agcattgaaactcatcgaggttgaa

SEQ ID NO: 208402 - DNA, 25 bp, E. coli
agcattgaaactgatcgaggttgaa

SEQ ID NO: 208403 - DNA, 25 bp, E. coli
ttgaaactcatccaggttgaatatg

SEQ ID NO: 208404 - DNA, 25 bp, E. coli
ttgaaactcatcgaggttgaatatg

SEQ ID NO: 208405 - DNA, 25 bp, E. coli
tcgaagcattgaaactcatcgaggt

SEQ ID NO: 208406 - DNA, 25 bp, E. coli
tcgaagcattgatactcatcgaggt

SEQ ID NO: 208407 - DNA, 25 bp, E. coli
gctcgaagcattcaaactcatcgag

SEQ ID NO: 208408 - DNA, 25 bp, E. coli
gcattgaaactcatcgaggttgaat

SEQ ID NO: 208409 - DNA, 25 bp, E. coli
gcattgaaactcttcgaggttgaat

SEQ ID NO: 208410 - DNA, 25 bp, E. coli
gctcgaagcattgaaactcatcgag

SEQ ID NO: 208411 - DNA, 25 bp, E. coli
gaagcattgaaactcatcgaggttg

SEQ ID NO: 208412 - DNA, 25 bp, E. coli
gaagcattgaaagtcatcgaggttg

SEQ ID NO: 208413 - DNA, 25 bp, E. coli
cgttgctgcggtggtcgctgaaagt

SEQ ID NO: 208414 - DNA, 25 bp, E. coli
cgcgttgctgcggtggtcgctgaaa

SEQ ID NO: 208415 - DNA, 25 bp, E. coli
cgaagcattgaaactcatcgaggtt

SEQ ID NO: 208416 - DNA, 25 bp, E. coli
cgaagcattgaatctcatcgaggtt

SEQ ID NO: 208417 - DNA, 25 bp, E. coli
cgttgctgcggtcgtcgctgaaagt

SEQ ID NO: 208418 - DNA, 25 bp, E. coli
cgcgttgctgcgctggtcgctgaaa

SEQ ID NO: 208419 - DNA, 25 bp, E. coli
acatcagatcctggacctgggcgat

SEQ ID NO: 208420 - DNA, 25 bp, E. coli
acatcagatcctcgacctgggcgat

SEQ ID NO: 208421 - DNA, 25 bp, E. coli
tgaggccgctcgactggcttgtctg

SEQ ID NO: 208422 - DNA, 25 bp, E. coli
tgaggccgctcgtctggcttgtctg

SEQ ID NO: 208423 - DNA, 25 bp, E. coli
tgctggacgccgtcggacatcagat

SEQ ID NO: 208424 - DNA, 25 bp, E. coli
tgctggacgccgacggacatcagat

SEQ ID NO: 208425 - DNA, 25 bp, E. coli
tcagatcctcgacctgggcgatgat

SEQ ID NO: 208426 - DNA, 25 bp, E. coli
tcagatcctcgagctgggcgatgat

SEQ ID NO: 208427 - DNA, 25 bp, E. coli
gacggacatcagatcctcgacctgg

SEQ ID NO: 208428 - DNA, 25 bp, E. coli
cgacctgggcgaagatttttacacc

SEQ ID NO: 208429 - DNA, 25 bp, E. coli
cgacctgggcgatgatttttacacc

SEQ ID NO: 208430 - DNA, 25 bp, E. coli
cgctcgtctggcatgtctgctttca

SEQ ID NO: 208431 - DNA, 25 bp, E. coli
cgctcgtctggcttgtctgctttca

SEQ ID NO: 208432 - DNA, 25 bp, E. coli
ctcgtctggcttctctgctttcacg

SEQ ID NO: 208433 - DNA, 25 bp, E. coli
ctcgtctggcttgtctgctttcacg

SEQ ID NO: 208434 - DNA, 25 bp, E. coli
tggacgccgacgcacatcagatcct

SEQ ID NO: 208435 - DNA, 25 bp, E. coli
tggacgccgacggacatcagatcct

SEQ ID NO: 208436 - DNA, 25 bp, E. coli
gatcgcggtagtcagttcgctgccg

SEQ ID NO: 208437 - DNA, 25 bp, E. coli
gatcctcgacctcggcgatgatttt

SEQ ID NO: 208438 - DNA, 25 bp, E. coli
gacggacatcagttcctcgacctgg

SEQ ID NO: 208439 - DNA, 25 bp, E. coli
gatcctcgacctgggcgatgatttt

SEQ ID NO: 208440 - DNA, 25 bp, E. coli
gatcgcggtagtgagttcgctgccg

SEQ ID NO: 208441 - DNA, 25 bp, E. coli
attattcagataggacacatccttt

SEQ ID NO: 208442 - DNA, 25 bp, E. coli
attcctgattatacagatacgacac

SEQ ID NO: 208443 - DNA, 25 bp, E. coli
attcctgattattcagatacgacac

SEQ ID NO: 208444 - DNA, 25 bp, E. coli
attattcagatacgacacatccttt

SEQ ID NO: 208445 - DNA, 25 bp, E. coli
tattcctgattattcagatacgaca

SEQ ID NO: 208446 - DNA, 25 bp, E. coli
tattcagatacgacacatcctttca

SEQ ID NO: 208447 - DNA, 25 bp, E. coli
ttattcagatacgacacatcctttc

SEQ ID NO: 208448 - DNA, 25 bp, E. coli
tattcagatacgtcacatcctttca

SEQ ID NO: 208449 - DNA, 25 bp, E. coli
tattcctgattaatcagatacgaca

SEQ ID NO: 208450 - DNA, 25 bp, E. coli
ttcctgattattgagatacgacaca

SEQ ID NO: 208451 - DNA, 25 bp, E. coli
ttcctgattattcagatacgacaca

SEQ ID NO: 208452 - DNA, 25 bp, E. coli
ttattcagataccacacatcctttc

SEQ ID NO: 208453 - DNA, 25 bp, E. coli
tgattattcagatacgacacatcct

SEQ ID NO: 208454 - DNA, 25 bp, E. coli
tgattattcagaaacgacacatcct

SEQ ID NO: 208455 - DNA, 25 bp, E. coli
tcctgattattcagatacgacacat

SEQ ID NO: 208456 - DNA, 25 bp, E. coli
tcctgattattctgatacgacacat

SEQ ID NO: 208457 - DNA, 25 bp, E. coli
cctgattattcacatacgacacatc

SEQ ID NO: 208458 - DNA, 25 bp, E. coli
cctgattattcagatacgacacatc

SEQ ID NO: 208459 - DNA, 25 bp, E. coli
ctgattattcagatacgacacatcc

SEQ ID NO: 208460 - DNA, 25 bp, E. coli
ctgattattcagttacgacacatcc

SEQ ID NO: 208461 - DNA, 25 bp, E. coli
gattattcagattcgacacatcctt

SEQ ID NO: 208462 - DNA, 25 bp, E. coli
gattattcagatacgacacatcctt

SEQ ID NO: 208463 - DNA, 25 bp, E. coli
aagtatcagtatactgcgcgacgcc

SEQ ID NO: 208464 - DNA, 25 bp, E. coli
aagtatcagtattctgcgcgacgcc

SEQ ID NO: 208465 - DNA, 25 bp, E. coli
cagaagttaccatagcctggcgtgc

SEQ ID NO: 208466 - DNA, 25 bp, E. coli
cagaagttaccaaagcctggcgtgc

SEQ ID NO: 208467 - DNA, 25 bp, E. coli
cagattatcgtgttgccgcattgcg

SEQ ID NO: 208468 - DNA, 25 bp, E. coli
cagattatcgtgatgccgcattgcg

SEQ ID NO: 208469 - DNA, 25 bp, E. coli
tcgccggaggcgttgcaaagtatca

SEQ ID NO: 208470 - DNA, 25 bp, E. coli
tcgccatcggtgtaaaactgtacgc

SEQ ID NO: 208471 - DNA, 25 bp, E. coli
tcgccggaggcgatgcaaagtatca

SEQ ID NO: 208472 - DNA, 25 bp, E. coli
tcgccatcggtgaaaaactgtacgc

SEQ ID NO: 208473 - DNA, 25 bp, E. coli
gctaatgccatctagctgttcccgg

SEQ ID NO: 208474 - DNA, 25 bp, E. coli
gctaatgccatcaagctgttcccgg

SEQ ID NO: 208475 - DNA, 25 bp, E. coli
gaagcctttgctgccattgaacatg

SEQ ID NO: 208476 - DNA, 25 bp, E. coli
gaagcctttgctcccattgaacatg

SEQ ID NO: 208477 - DNA, 25 bp, E. coli
cattgcgatactgcggtgatccgtc

SEQ ID NO: 208478 - DNA, 25 bp, E. coli
cattgcgatactccggtgatccgtc

SEQ ID NO: 208479 - DNA, 25 bp, E. coli
cgtgaaaccggaagagattgtcgcc

SEQ ID NO: 208480 - DNA, 25 bp, E. coli
cgtgaaaccggatgagattgtcgcc

SEQ ID NO: 208481 - DNA, 25 bp, E. coli
ggtatcacaccggaaaccatggcgc

SEQ ID NO: 208482 - DNA, 25 bp, E. coli
ggtatcacaccgcaaaccatggcgc

SEQ ID NO: 208483 - DNA, 25 bp, E. coli
gagattcctatgtactcgccggagg

SEQ ID NO: 208484 - DNA, 25 bp, E. coli
gagattcctatgaactcgccggagg

SEQ ID NO: 208485 - DNA, 25 bp, E. coli
cacagctttctggtgcagtcgctgg

SEQ ID NO: 208486 - DNA, 25 bp, E. coli
cacagctttctgctgcagtcgctgg

SEQ ID NO: 208487 - DNA, 25 bp, E. coli
catttcaggaagtggatgtcctggg

SEQ ID NO: 208488 - DNA, 25 bp, E. coli
catttcaggaagaggatgtcctggg

SEQ ID NO: 208489 - DNA, 25 bp, E. coli
cagtcgctggaacagttgccgcgca

SEQ ID NO: 208490 - DNA, 25 bp, E. coli
cagtcgctggaagagttgccgcgca

SEQ ID NO: 208491 - DNA, 25 bp, E. coli
taccaagcacaggtttctggtgcag

SEQ ID NO: 208492 - DNA, 25 bp, E. coli
taccaagcacagctttctggtgcag

SEQ ID NO: 208493 - DNA, 25 bp, E. coli
tgccatcaccggacaagtgtccgca

SEQ ID NO: 208494 - DNA, 25 bp, E. coli
tgccatcaccggtcaagtgtccgca

SEQ ID NO: 208495 - DNA, 25 bp, E. coli
cctgttgttgccttcaccggtcaag

SEQ ID NO: 208496 - DNA, 25 bp, E. coli
cctgttgttgccatcaccggtcaag

SEQ ID NO: 208497 - DNA, 25 bp, E. coli
cctgggattgtccttagcctgtacc

SEQ ID NO: 208498 - DNA, 25 bp, E. coli
ccgacatgagcacggtgcggcaatg

SEQ ID NO: 208499 - DNA, 25 bp, E. coli
cctgggattgtcgttagcctgtacc

SEQ ID NO: 208500 - DNA, 25 bp, E. coli
ccgacatgagcagggtgcggcaatg

SEQ ID NO: 208501 - DNA, 25 bp, E. coli
gttagcctgtaccaagcacagcttt

SEQ ID NO: 208502 - DNA, 25 bp, E. coli
gttagcctgtacgaagcacagcttt

SEQ ID NO: 208503 - DNA, 25 bp, E. coli
gacgcatttcagcaagtggatgtcc

SEQ ID NO: 208504 - DNA, 25 bp, E. coli
gatgtcctgggaatgtcgttagcct

SEQ ID NO: 208505 - DNA, 25 bp, E. coli
gacgcatttcaggaagtggatgtcc

SEQ ID NO: 208506 - DNA, 25 bp, E. coli
gatgtcctgggattgtcgttagcct

SEQ ID NO: 208507 - DNA, 25 bp, E. coli
actttctataaacagggagggtgca

SEQ ID NO: 208508 - DNA, 25 bp, E. coli
aaatctttttgcaattcccctggtg

SEQ ID NO: 208509 - DNA, 25 bp, E. coli
actttctataaagagggagggtgca

SEQ ID NO: 208510 - DNA, 25 bp, E. coli
aaatctttttgctattcccctggtg

SEQ ID NO: 208511 - DNA, 25 bp, E. coli
tattctggaacatgggttatggttt

SEQ ID NO: 208512 - DNA, 25 bp, E. coli
tattctggaacaagggttatggttt

SEQ ID NO: 208513 - DNA, 25 bp, E. coli
tgtggaacgcggatattcttggatt

SEQ ID NO: 208514 - DNA, 25 bp, E. coli
tgtggaacgcggttattcttggatt

SEQ ID NO: 208515 - DNA, 25 bp, E. coli
tgcaggactcatacgcggtgggcaa

SEQ ID NO: 208516 - DNA, 25 bp, E. coli
tgcaggactcattcgcggtgggcaa

SEQ ID NO: 208517 - DNA, 25 bp, E. coli
tgccctcaagcatagttaaacatcg

SEQ ID NO: 208518 - DNA, 25 bp, E. coli
tgccctcaagcaaagttaaacatcg

SEQ ID NO: 208519 - DNA, 25 bp, E. coli
gcgtaccgtggtcgcgcttgccatt

SEQ ID NO: 208520 - DNA, 25 bp, E. coli
gcgtaccgtggtggcgcttgccatt

SEQ ID NO: 208521 - DNA, 25 bp, E. coli
gctgcaaccctaaatgtggaacgcg

SEQ ID NO: 208522 - DNA, 25 bp, E. coli
gctgcaaccctatatgtggaacgcg

SEQ ID NO: 208523 - DNA, 25 bp, E. coli
gcaatggtcattccgcgaaacggca

SEQ ID NO: 208524 - DNA, 25 bp, E. coli
gcaatggtcattgcgcgaaacggca

SEQ ID NO: 208525 - DNA, 25 bp, E. coli
gcaagtttttctgcctgggtgctgg

SEQ ID NO: 208526 - DNA, 25 bp, E. coli
gcaagtttttctccctgggtgctgg

SEQ ID NO: 208527 - DNA, 25 bp, E. coli
taagcgggccgtttattctggaaca

SEQ ID NO: 208528 - DNA, 25 bp, E. coli
taagcgggccgtatattctggaaca

SEQ ID NO: 208529 - DNA, 25 bp, E. coli
caatcgggcgatgattaagcgtcac

SEQ ID NO: 208530 - DNA, 25 bp, E. coli
caatcgggcgatcattaagcgtcac

SEQ ID NO: 208531 - DNA, 25 bp, E. coli
caaaactatattggcgaagcgcact

SEQ ID NO: 208532 - DNA, 25 bp, E. coli
caaaactatattcgcgaagcgcact

SEQ ID NO: 208533 - DNA, 25 bp, E. coli
ttacgtctctcttttcgcgaaggga

SEQ ID NO: 208534 - DNA, 25 bp, E. coli
ttacgtctctctattcgcgaaggga

SEQ ID NO: 208535 - DNA, 25 bp, E. coli
tgaactgggtcaacaagaaggcgta

SEQ ID NO: 208536 - DNA, 25 bp, E. coli
tgaactgggtcatcaagaaggcgta

SEQ ID NO: 208537 - DNA, 25 bp, E. coli
tgccagatgagatccagcgtagcct

SEQ ID NO: 208538 - DNA, 25 bp, E. coli
tgctgacgcctaggctactggttat

SEQ ID NO: 208539 - DNA, 25 bp, E. coli
tgctgacgcctacgctactggttat

SEQ ID NO: 208540 - DNA, 25 bp, E. coli
tgccagatgagaaccagcgtagcct

SEQ ID NO: 208541 - DNA, 25 bp, E. coli
cgcgattgtttaccctgccagatga

SEQ ID NO: 208542 - DNA, 25 bp, E. coli
cgcgattgtttagcctgccagatga

SEQ ID NO: 208543 - DNA, 25 bp, E. coli
cattgatgcctcaggtgctgacgcc

SEQ ID NO: 208544 - DNA, 25 bp, E. coli
cattgatgcctctggtgctgacgcc

SEQ ID NO: 208545 - DNA, 25 bp, E. coli
ggtaccagtgtatgacaatcgggcg

SEQ ID NO: 208546 - DNA, 25 bp, E. coli
ggtaccagtgtaagacaatcgggcg

SEQ ID NO: 208547 - DNA, 25 bp, E. coli
tcaccggtgtgtatggcatggcgat

SEQ ID NO: 208548 - DNA, 25 bp, E. coli
tcaccggtgtgtttggcatggcgat

SEQ ID NO: 208549 - DNA, 25 bp, E. coli
tcactggatgtccttgacggcaggc

SEQ ID NO: 208550 - DNA, 25 bp, E. coli
tcactggatgtcgttgacggcaggc

SEQ ID NO: 208551 - DNA, 25 bp, E. coli
caactttgtttcaacctgcgggcga

SEQ ID NO: 208552 - DNA, 25 bp, E. coli
caacaatctgtatagcgggcaagcg

SEQ ID NO: 208553 - DNA, 25 bp, E. coli
caacaatctgtaaagcgggcaagcg

SEQ ID NO: 208554 - DNA, 25 bp, E. coli
caactttgtttctacctgcgggcga

SEQ ID NO: 208555 - DNA, 25 bp, E. coli
catcagtggctgtgggatctcttcc

SEQ ID NO: 208556 - DNA, 25 bp, E. coli
catcagtggctgagggatctcttcc

SEQ ID NO: 208557 - DNA, 25 bp, E. coli
tttttgtactgtggcaggaacgccc

SEQ ID NO: 208558 - DNA, 25 bp, E. coli
tttttgtactgtcgcaggaacgccc

SEQ ID NO: 208559 - DNA, 25 bp, E. coli
ttatcgtcgggatgaactccagggc

SEQ ID NO: 208560 - DNA, 25 bp, E. coli
ttatcgtcgggaagaactccagggc

SEQ ID NO: 208561 - DNA, 25 bp, E. coli
tggttgcatcaagaacaggcggcgc

SEQ ID NO: 208562 - DNA, 25 bp, E. coli
tgaaacgttcaccatcgaatgccgg

SEQ ID NO: 208563 - DNA, 25 bp, E. coli
tgaaacgttcacgatcgaatgccgg

SEQ ID NO: 208564 - DNA, 25 bp, E. coli
gctgcgtaccggtcaacaactttgt

SEQ ID NO: 208565 - DNA, 25 bp, E. coli
gctgcgtaccggacaacaactttgt

SEQ ID NO: 208566 - DNA, 25 bp, E. coli
gaataaccttacataccggccagct

SEQ ID NO: 208567 - DNA, 25 bp, E. coli
gaatgccggtcatttgtgcccgagc

SEQ ID NO: 208568 - DNA, 25 bp, E. coli
gaataaccttacttaccggccagct

SEQ ID NO: 208569 - DNA, 25 bp, E. coli
gaatgccggtcaattgtgcccgagc

SEQ ID NO: 208570 - DNA, 25 bp, E. coli
ccctggcggcaaagaaaggcaattt

SEQ ID NO: 208571 - DNA, 25 bp, E. coli
ccctggcggcaatgaaaggcaattt

SEQ ID NO: 208572 - DNA, 25 bp, E. coli
tggttgcatcaacaacaggcggcgc

SEQ ID NO: 208573 - DNA, 25 bp, E. coli
aattccggtgcaaaaagttctgcgc

SEQ ID NO: 208574 - DNA, 25 bp, E. coli
aattccggtgcataaagttctgcgc

SEQ ID NO: 208575 - DNA, 25 bp, E. coli
tggtgcagatccagaaaaatacccg

SEQ ID NO: 208576 - DNA, 25 bp, E. coli
tggtgcagatcctgaaaaatacccg

SEQ ID NO: 208577 - DNA, 25 bp, E. coli
tgcagcagggcagcattgttatgct

SEQ ID NO: 208578 - DNA, 25 bp, E. coli
tgacgctgatggagcctttcctcgc

SEQ ID NO: 208579 - DNA, 25 bp, E. coli
tgcagcagggcaccattgttatgct

SEQ ID NO: 208580 - DNA, 25 bp, E. coli
tgacgggcgtttgacacatgattcc

SEQ ID NO: 208581 - DNA, 25 bp, E. coli
tgacgctgatggtgcctttcctcgc

SEQ ID NO: 208582 - DNA, 25 bp, E. coli
tgacgggcgtttcacacatgattcc

SEQ ID NO: 208583 - DNA, 25 bp, E. coli
ccggttaacaaagtggcctatgcct

SEQ ID NO: 208584 - DNA, 25 bp, E. coli
ccggttaacaaactggcctatgcct

SEQ ID NO: 208585 - DNA, 25 bp, E. coli
gctatcggtgccagggttggtaaca

SEQ ID NO: 208586 - DNA, 25 bp, E. coli
gcggcatcgtggagcattacctgaa

SEQ ID NO: 208587 - DNA, 25 bp, E. coli
gcggcatcgtggtgcattacctgaa

SEQ ID NO: 208588 - DNA, 25 bp, E. coli
gctatcggtgcctgggttggtaaca

SEQ ID NO: 208589 - DNA, 25 bp, E. coli
cgtcatgttgtaaggcaaaggcgca

SEQ ID NO: 208590 - DNA, 25 bp, E. coli
cgtcatgttgtatggcaaaggcgca

SEQ ID NO: 208591 - DNA, 25 bp, E. coli
gattggtcgtaataatttctccgca

SEQ ID NO: 208592 - DNA, 25 bp, E. coli
tgattcccttcgaggtatcgggcgg

SEQ ID NO: 208593 - DNA, 25 bp, E. coli
tgattcccttcgtggtatcgggcgg

SEQ ID NO: 208594 - DNA, 25 bp, E. coli
gattggtcgtaaaaatttctccgca

SEQ ID NO: 208595 - DNA, 25 bp, E. coli
cagacgcggtgcatgagttcaacaa

SEQ ID NO: 208596 - DNA, 25 bp, E. coli
cagacgcggtgcttgagttcaacaa

SEQ ID NO: 208597 - DNA, 25 bp, E. coli
tcggcggagccactctatgggtaat

SEQ ID NO: 208598 - DNA, 25 bp, E. coli
tcggcggagccagtctatgggtaat

SEQ ID NO: 208599 - DNA, 25 bp, E. coli
ccagtctatgggtaatgcagggtaa

SEQ ID NO: 208600 - DNA, 25 bp, E. coli
ccagtctatgggaaatgcagggtaa

SEQ ID NO: 208601 - DNA, 25 bp, E. coli
gaaaaacccaggtgcggatattgcc

SEQ ID NO: 208602 - DNA, 25 bp, E. coli
gactggctttaatggcaaatgcgca

SEQ ID NO: 208603 - DNA, 25 bp, E. coli
gaaaaacccaggagcggatattgcc

SEQ ID NO: 208604 - DNA, 25 bp, E. coli
cggatattgccaggcgtcagatgct

SEQ ID NO: 208605 - DNA, 25 bp, E. coli
cggatattgccacgcgtcagatgct

SEQ ID NO: 208606 - DNA, 25 bp, E. coli
gatactgccgttgagcgtgggaacc

SEQ ID NO: 208607 - DNA, 25 bp, E. coli
gatactgccgttcagcgtgggaacc

SEQ ID NO: 208608 - DNA, 25 bp, E. coli
ggctatctgccaatcactaaagcgg

SEQ ID NO: 208609 - DNA, 25 bp, E. coli
ggaaccagttatagcgccgctttga

SEQ ID NO: 208610 - DNA, 25 bp, E. coli
ggctatctgccattcactaaagcgg

SEQ ID NO: 208611 - DNA, 25 bp, E. coli
ggaaccagttattgcgccgctttga

SEQ ID NO: 208612 - DNA, 25 bp, E. coli
tggcaaatgcgcaggcagtgacgac

SEQ ID NO: 208613 - DNA, 25 bp, E. coli
tggcaaatgcgctggcagtgacgac

SEQ ID NO: 208614 - DNA, 25 bp, E. coli
ggcgctcggactggctttaatggca

SEQ ID NO: 208615 - DNA, 25 bp, E. coli
ggcgctcggactcgctttaatggca

SEQ ID NO: 208616 - DNA, 25 bp, E. coli
gactggctttaaaggcaaatgcgca

SEQ ID NO: 208617 - DNA, 25 bp, E. coli
caggcatcggagcacttattgccgg

SEQ ID NO: 208618 - DNA, 25 bp, E. coli
catcggagcactaattgccggatgc

SEQ ID NO: 208619 - DNA, 25 bp, E. coli
catcggagcacttattgccggatgc

SEQ ID NO: 208620 - DNA, 25 bp, E. coli
catcaggcatgaagcgccaattgcc

SEQ ID NO: 208621 - DNA, 25 bp, E. coli
catgatgcgccaattgcctacgttt

SEQ ID NO: 208622 - DNA, 25 bp, E. coli
caggcatcggaggacttattgccgg

SEQ ID NO: 208623 - DNA, 25 bp, E. coli
catcaggcatgatgcgccaattgcc

SEQ ID NO: 208624 - DNA, 25 bp, E. coli
catgatgcgccatttgcctacgttt

SEQ ID NO: 208625 - DNA, 25 bp, E. coli
ccctacgcggttctggcacattttg

SEQ ID NO: 208626 - DNA, 25 bp, E. coli
ccctacgcggttgtggcacattttg

SEQ ID NO: 208627 - DNA, 25 bp, E. coli
acgcggttctggcacattttgcagg

SEQ ID NO: 208628 - DNA, 25 bp, E. coli
acgcggttctgggacattttgcagg

SEQ ID NO: 208629 - DNA, 25 bp, E. coli
tccggcctacggatctggcaccttt

SEQ ID NO: 208630 - DNA, 25 bp, E. coli
tccggcctacggttctggcaccttt

SEQ ID NO: 208631 - DNA, 25 bp, E. coli
tctggcacattttgcaggcctgata

SEQ ID NO: 208632 - DNA, 25 bp, E. coli
tctggcacatttagcaggcctgata

SEQ ID NO: 208633 - DNA, 25 bp, E. coli
gttatagtctcgctgctcattactt

SEQ ID NO: 208634 - DNA, 25 bp, E. coli
gttatagtctcggtgctcattactt

SEQ ID NO: 208635 - DNA, 25 bp, E. coli
ggttctggcaccttttgtaggcctg

SEQ ID NO: 208636 - DNA, 25 bp, E. coli
ggttctggcaccatttgtaggcctg

SEQ ID NO: 208637 - DNA, 25 bp, E. coli
ggtgctcattacatattgccggatg

SEQ ID NO: 208638 - DNA, 25 bp, E. coli
ggtgctcattacttattgccggatg

SEQ ID NO: 208639 - DNA, 25 bp, E. coli
aatattcataatgttcagccgtggc

SEQ ID NO: 208640 - DNA, 25 bp, E. coli
aagacatcgcatttttgccggaagg

SEQ ID NO: 208641 - DNA, 25 bp, E. coli
aagacatcgcatatttgccggaagg

SEQ ID NO: 208642 - DNA, 25 bp, E. coli
aatattcataatcttcagccgtggc

SEQ ID NO: 208643 - DNA, 25 bp, E. coli
tacgccaggcgaatgagcatatcaa

SEQ ID NO: 208644 - DNA, 25 bp, E. coli
taccgactggttagctgataaagac

SEQ ID NO: 208645 - DNA, 25 bp, E. coli
tacgccaggcgattgagcatatcaa

SEQ ID NO: 208646 - DNA, 25 bp, E. coli
taccgactggtttgctgataaagac

SEQ ID NO: 208647 - DNA, 25 bp, E. coli
gcccaggttcgcaaagcagtagtga

SEQ ID NO: 208648 - DNA, 25 bp, E. coli
gccggaaggcgtagatgagaaaaca

SEQ ID NO: 208649 - DNA, 25 bp, E. coli
gccggaaggcgttgatgagaaaaca

SEQ ID NO: 208650 - DNA, 25 bp, E. coli
gcccaggttcgctaagcagtagtga

SEQ ID NO: 208651 - DNA, 25 bp, E. coli
gaagctcgccgtccggagtaccatg

SEQ ID NO: 208652 - DNA, 25 bp, E. coli
gaagatatgacccagccgtacgaag

SEQ ID NO: 208653 - DNA, 25 bp, E. coli
gaagtgcataaaccgctgtgcgcag

SEQ ID NO: 208654 - DNA, 25 bp, E. coli
gaagctcgccgtgcggagtaccatg

SEQ ID NO: 208655 - DNA, 25 bp, E. coli
gaagatatgaccgagccgtacgaag

SEQ ID NO: 208656 - DNA, 25 bp, E. coli
gaagtgcataaagcgctgtgcgcag

SEQ ID NO: 208657 - DNA, 25 bp, E. coli
gttacggcagaatcgccaaagggca

SEQ ID NO: 208658 - DNA, 25 bp, E. coli
gttacggcagaaacgccaaagggca

SEQ ID NO: 208659 - DNA, 25 bp, E. coli
gagcatatcaaaccacacgttacgg

SEQ ID NO: 208660 - DNA, 25 bp, E. coli
gagcatatcaaagcacacgttacgg

SEQ ID NO: 208661 - DNA, 25 bp, E. coli
aaccgtttatacgtgcaggacggcg

SEQ ID NO: 208662 - DNA, 25 bp, E. coli
aaccgtttatacctgcaggacggcg

SEQ ID NO: 208663 - DNA, 25 bp, E. coli
caaccgtttatacgtgcaggacggc

SEQ ID NO: 208664 - DNA, 25 bp, E. coli
caaccgtttataggtgcaggacggc

SEQ ID NO: 208665 - DNA, 25 bp, E. coli
cagccgattggcgttacagcggcca

SEQ ID NO: 208666 - DNA, 25 bp, E. coli
cagccgattggccttacagcggcca

SEQ ID NO: 208667 - DNA, 25 bp, E. coli
tacagcggccatcacgccgtggaac

SEQ ID NO: 208668 - DNA, 25 bp, E. coli
tacagcggccatgacgccgtggaac

SEQ ID NO: 208669 - DNA, 25 bp, E. coli
tgcgccaaccgtatatacgtgcagg

SEQ ID NO: 208670 - DNA, 25 bp, E. coli
tgcgccaaccgtttatacgtgcagg

SEQ ID NO: 208671 - DNA, 25 bp, E. coli
ccgattggcgttacagcggccatca

SEQ ID NO: 208672 - DNA, 25 bp, E. coli
gccaaccgtttatacgtgcaggacg

SEQ ID NO: 208673 - DNA, 25 bp, E. coli
ccgattggcgtttcagcggccatca

SEQ ID NO: 208674 - DNA, 25 bp, E. coli
gccaaccgtttaaacgtgcaggacg

SEQ ID NO: 208675 - DNA, 25 bp, E. coli
ccgtttatacgtccaggacggcgtg

SEQ ID NO: 208676 - DNA, 25 bp, E. coli
ccgtttatacgtgcaggacggcgtg

SEQ ID NO: 208677 - DNA, 25 bp, E. coli
cgtctgcgccaagcgtttatacgtg

SEQ ID NO: 208678 - DNA, 25 bp, E. coli
cgtctgcgccaaccgtttatacgtg

SEQ ID NO: 208679 - DNA, 25 bp, E. coli
gattggcgttactgcggccatcacg

SEQ ID NO: 208680 - DNA, 25 bp, E. coli
gttacagcggccatcacgccgtgga

SEQ ID NO: 208681 - DNA, 25 bp, E. coli
gattggcgttacagcggccatcacg

SEQ ID NO: 208682 - DNA, 25 bp, E. coli
gttacagcggccttcacgccgtgga

SEQ ID NO: 208683 - DNA, 25 bp, E. coli
caattattagtggtggatgaaccca

SEQ ID NO: 208684 - DNA, 25 bp, E. coli
caattattagtgctggatgaaccca

SEQ ID NO: 208685 - DNA, 25 bp, E. coli
cacatttgttgttccggcacaccgg

SEQ ID NO: 208686 - DNA, 25 bp, E. coli
cacatttgttgtaccggcacaccgg

SEQ ID NO: 208687 - DNA, 25 bp, E. coli
tagtgctcgggcaggtaacacccga

SEQ ID NO: 208688 - DNA, 25 bp, E. coli
tatgtaccgcagaagctgtatctcg

SEQ ID NO: 208689 - DNA, 25 bp, E. coli
tagtgctcgggctggtaacacccga

SEQ ID NO: 208690 - DNA, 25 bp, E. coli
tatgtaccgcagtagctgtatctcg

SEQ ID NO: 208691 - DNA, 25 bp, E. coli
tatatgaccttattgaccaactgcg

SEQ ID NO: 208692 - DNA, 25 bp, E. coli
tatatgaccttaatgaccaactgcg

SEQ ID NO: 208693 - DNA, 25 bp, E. coli
ttatcaagcgcaacggaaaactgcg

SEQ ID NO: 208694 - DNA, 25 bp, E. coli
ttatcaagcgcatcggaaaactgcg

SEQ ID NO: 208695 - DNA, 25 bp, E. coli
tgtgtcgctggaacttaaacctgga

SEQ ID NO: 208696 - DNA, 25 bp, E. coli
tgtgtcgctggatcttaaacctgga

SEQ ID NO: 208697 - DNA, 25 bp, E. coli
tcctcgtggtgctgaacaactgggt

SEQ ID NO: 208698 - DNA, 25 bp, E. coli
tcctcgtggtgcagaacaactgggt

SEQ ID NO: 208699 - DNA, 25 bp, E. coli
gaagttgtttccgtgcatccggagt

SEQ ID NO: 208700 - DNA, 25 bp, E. coli
gaagttgtttccctgcatccggagt

SEQ ID NO: 208701 - DNA, 25 bp, E. coli
gaaaactgcgcaacggctatgtacc

SEQ ID NO: 208702 - DNA, 25 bp, E. coli
gaaaactgcgcatcggctatgtacc

SEQ ID NO: 208703 - DNA, 25 bp, E. coli
gtatctcgacaccacgttgccactg

SEQ ID NO: 208704 - DNA, 25 bp, E. coli
gtatctcgacacgacgttgccactg

SEQ ID NO: 208705 - DNA, 25 bp, E. coli
aacgactgggctatgagcgaatgcc

SEQ ID NO: 208706 - DNA, 25 bp, E. coli
aacgactgggctttgagcgaatgcc

SEQ ID NO: 208707 - DNA, 25 bp, E. coli
cttcatggtgttgaggatagcggtc

SEQ ID NO: 208708 - DNA, 25 bp, E. coli
cttcatggtgttcaggatagcggtc

SEQ ID NO: 208709 - DNA, 25 bp, E. coli
taacagcgttgaccgttacctgccg

SEQ ID NO: 208710 - DNA, 25 bp, E. coli
agcaggcgttttcttttgaggcacc

SEQ ID NO: 208711 - DNA, 25 bp, E. coli
agcaggcgttttgttttgaggcacc

SEQ ID NO: 208712 - DNA, 25 bp, E. coli
tatgcagcgtgttgtgagaaattcc

SEQ ID NO: 208713 - DNA, 25 bp, E. coli
tatccggctgggaaaacgactgggc

SEQ ID NO: 208714 - DNA, 25 bp, E. coli
tatccggctgggtaaacgactgggc

SEQ ID NO: 208715 - DNA, 25 bp, E. coli
tatgcagcgtgtagtgagaaattcc

SEQ ID NO: 208716 - DNA, 25 bp, E. coli
tgaatgaagttaaagacgcctgcct

SEQ ID NO: 208717 - DNA, 25 bp, E. coli
tgctcagtgctgttggtatccctta

SEQ ID NO: 208718 - DNA, 25 bp, E. coli
tgaagacattaacccatctggctgg

SEQ ID NO: 208719 - DNA, 25 bp, E. coli
tgaatgaagttatagacgcctgcct

SEQ ID NO: 208720 - DNA, 25 bp, E. coli
tgctcagtgctgatggtatccctta

SEQ ID NO: 208721 - DNA, 25 bp, E. coli
tgaagacattaagccatctggctgg

SEQ ID NO: 208722 - DNA, 25 bp, E. coli
tcccgcaaccctgaatttatgaatg

SEQ ID NO: 208723 - DNA, 25 bp, E. coli
tcccgcaaccctcaatttatgaatg

SEQ ID NO: 208724 - DNA, 25 bp, E. coli
cgctgggctgagttccatacggcaa

SEQ ID NO: 208725 - DNA, 25 bp, E. coli
cgctgggctgagatccatacggcaa

SEQ ID NO: 208726 - DNA, 25 bp, E. coli
taacagcgttgagcgttacctgccg

SEQ ID NO: 208727 - DNA, 25 bp, E. coli
catggcattacttcgctgtgtttgt

SEQ ID NO: 208728 - DNA, 25 bp, E. coli
catgagtacgcagctggaaggattc

SEQ ID NO: 208729 - DNA, 25 bp, E. coli
catgagtacgcacctggaaggattc

SEQ ID NO: 208730 - DNA, 25 bp, E. coli
catggcattactacgctgtgtttgt

SEQ ID NO: 208731 - DNA, 25 bp, E. coli
actattggccccactggtggtgatg

SEQ ID NO: 208732 - DNA, 25 bp, E. coli
actattggcccctctggtggtgatg

SEQ ID NO: 208733 - DNA, 25 bp, E. coli
tattgactggttggccggtaccatg

SEQ ID NO: 208734 - DNA, 25 bp, E. coli
tattgactggttcgccggtaccatg

SEQ ID NO: 208735 - DNA, 25 bp, E. coli
gcaactctggttctgatggctaacg

SEQ ID NO: 208736 - DNA, 25 bp, E. coli
gcaactctggttgtgatggctaacg

SEQ ID NO: 208737 - DNA, 25 bp, E. coli
gactcgttctggttttattgactgg

SEQ ID NO: 208738 - DNA, 25 bp, E. coli
gactcgttctggatttattgactgg

SEQ ID NO: 208739 - DNA, 25 bp, E. coli
ccgcaggcatgggattacttcgctg

SEQ ID NO: 208740 - DNA, 25 bp, E. coli
ccgcaggcatggcattacttcgctg

SEQ ID NO: 208741 - DNA, 25 bp, E. coli
ggttcgccggtagcatgagtacgca

SEQ ID NO: 208742 - DNA, 25 bp, E. coli
ggttcgccggtaccatgagtacgca

SEQ ID NO: 208743 - DNA, 25 bp, E. coli
tgtgatggctaagggcctgactcgt

SEQ ID NO: 208744 - DNA, 25 bp, E. coli
ggctaacggcctgactcgttctggt

SEQ ID NO: 208745 - DNA, 25 bp, E. coli
ggctaacggcctcactcgttctggt

SEQ ID NO: 208746 - DNA, 25 bp, E. coli
tgtgatggctaacggcctgactcgt

SEQ ID NO: 208747 - DNA, 25 bp, E. coli
taatatatggaatctattggcccca

SEQ ID NO: 208748 - DNA, 25 bp, E. coli
taatatatggaaactattggcccca

SEQ ID NO: 208749 - DNA, 25 bp, E. coli
caaacctgtgcctgaaccgtaggcc

SEQ ID NO: 208750 - DNA, 25 bp, E. coli
caaacctgtgccagaaccgtaggcc

SEQ ID NO: 208751 - DNA, 25 bp, E. coli
taaagcagcgcaaccgcaatgatgt

SEQ ID NO: 208752 - DNA, 25 bp, E. coli
taaagcagcgcatccgcaatgatgt

SEQ ID NO: 208753 - DNA, 25 bp, E. coli
acctgtgcctgatccgtaggccgga

SEQ ID NO: 208754 - DNA, 25 bp, E. coli
acctgtgcctgaaccgtaggccgga

SEQ ID NO: 208755 - DNA, 25 bp, E. coli
atcgcttcatctggtaggccggata

SEQ ID NO: 208756 - DNA, 25 bp, E. coli
atcgcttcatctcgtaggccggata

SEQ ID NO: 208757 - DNA, 25 bp, E. coli
aaatgcgccaccctaaagcagcgca

SEQ ID NO: 208758 - DNA, 25 bp, E. coli
aaatgcgccaccgtaaagcagcgca

SEQ ID NO: 208759 - DNA, 25 bp, E. coli
aacatcgcttcatctcgtaggccgg

SEQ ID NO: 208760 - DNA, 25 bp, E. coli
aacatcgcttcaactcgtaggccgg

SEQ ID NO: 208761 - DNA, 25 bp, E. coli
tccggcagtcatccgtcgatgccaa

SEQ ID NO: 208762 - DNA, 25 bp, E. coli
tccggcagtcatgcgtcgatgccaa

SEQ ID NO: 208763 - DNA, 25 bp, E. coli
tcatgcgtcgatgccaaatgcgcca

SEQ ID NO: 208764 - DNA, 25 bp, E. coli
tcatgcgtcgatcccaaatgcgcca

SEQ ID NO: 208765 - DNA, 25 bp, E. coli
gccaaaacatcgcttcatctcgtag

SEQ ID NO: 208766 - DNA, 25 bp, E. coli
gccaaaacatcggttcatctcgtag

SEQ ID NO: 208767 - DNA, 25 bp, E. coli
ggcctacaaacctgtgcctgaaccg

SEQ ID NO: 208768 - DNA, 25 bp, E. coli
ggcatccgagcagcattgcctgatg

SEQ ID NO: 208769 - DNA, 25 bp, E. coli
ggcctacaaaccagtgcctgaaccg

SEQ ID NO: 208770 - DNA, 25 bp, E. coli
ggcatccgagcaccattgcctgatg

SEQ ID NO: 208771 - DNA, 25 bp, E. coli
agtcatggcagcgggcttcccacag

SEQ ID NO: 208772 - DNA, 25 bp, E. coli
agtcatggcagccggcttcccacag

SEQ ID NO: 208773 - DNA, 25 bp, E. coli
aaaggcgtgccggtgattatgaaag

SEQ ID NO: 208774 - DNA, 25 bp, E. coli
aaaggcgtgccgctgattatgaaag

SEQ ID NO: 208775 - DNA, 25 bp, E. coli
tggtcgcacaaagggcaggaaaaca

SEQ ID NO: 208776 - DNA, 25 bp, E. coli
tcgcacaaacgggaggaaaacatta

SEQ ID NO: 208777 - DNA, 25 bp, E. coli
tcgcacaaacggcaggaaaacatta

SEQ ID NO: 208778 - DNA, 25 bp, E. coli
gccggtgattatcaaagatattaac

SEQ ID NO: 208779 - DNA, 25 bp, E. coli
gccggtgattatgaaagatattaac

SEQ ID NO: 208780 - DNA, 25 bp, E. coli
gcacaaacggcaggaaaacattacc

SEQ ID NO: 208781 - DNA, 25 bp, E. coli
gcacaaacggcacgaaaacattacc

SEQ ID NO: 208782 - DNA, 25 bp, E. coli
cgtgccggtgataatgaaagatatt

SEQ ID NO: 208783 - DNA, 25 bp, E. coli
cgtgccggtgattatgaaagatatt

SEQ ID NO: 208784 - DNA, 25 bp, E. coli
gattatgaaagatattaacgacaag

SEQ ID NO: 208785 - DNA, 25 bp, E. coli
gattatgaaagaaattaacgacaag

SEQ ID NO: 208786 - DNA, 25 bp, E. coli
tggtcgcacaaacggcaggaaaaca

SEQ ID NO: 208787 - DNA, 25 bp, E. coli
ggcgtgccggtgtttatgaaagata

SEQ ID NO: 208788 - DNA, 25 bp, E. coli
ggcagtcatggcagcgggcttccca

SEQ ID NO: 208789 - DNA, 25 bp, E. coli
ggcagtcatggctgcgggcttccca

SEQ ID NO: 208790 - DNA, 25 bp, E. coli
ggcgtgccggtgattatgaaagata

SEQ ID NO: 208791 - DNA, 25 bp, E. coli
gatggtcgcacaaacggcaggaaaa

SEQ ID NO: 208792 - DNA, 25 bp, E. coli
gatggtcgcacatacggcaggaaaa

SEQ ID NO: 208793 - DNA, 25 bp, E. coli
cacccggtcattcgagtagtaacca

SEQ ID NO: 208794 - DNA, 25 bp, E. coli
cacccggtcattggagtagtaacca

SEQ ID NO: 208795 - DNA, 25 bp, E. coli
caaagcagatttagccagcatggaa

SEQ ID NO: 208796 - DNA, 25 bp, E. coli
caaagcagattttgccagcatggaa

SEQ ID NO: 208797 - DNA, 25 bp, E. coli
tctcagcgctgaagcaggaattaga

SEQ ID NO: 208798 - DNA, 25 bp, E. coli
tctcagcgctgatgcaggaattaga

SEQ ID NO: 208799 - DNA, 25 bp, E. coli
gccagcatggaagaaatatctttgg

SEQ ID NO: 208800 - DNA, 25 bp, E. coli
gccagcatggaacaaatatctttgg

SEQ ID NO: 208801 - DNA, 25 bp, E. coli
ccttgctgcatacagaagaaggctg

SEQ ID NO: 208802 - DNA, 25 bp, E. coli
ccttgctgcatagagaagaaggctg

SEQ ID NO: 208803 - DNA, 25 bp, E. coli
gttacgggaagctggagcgcacaac

SEQ ID NO: 208804 - DNA, 25 bp, E. coli
gttacgggaagcaggagcgcacaac

SEQ ID NO: 208805 - DNA, 25 bp, E. coli
gggccatgaatcacccggtcattgg

SEQ ID NO: 208806 - DNA, 25 bp, E. coli
ggagttacagaagtttttgccttgc

SEQ ID NO: 208807 - DNA, 25 bp, E. coli
gggccatgaatctcccggtcattgg

SEQ ID NO: 208808 - DNA, 25 bp, E. coli
ggagttacagaactttttgccttgc

SEQ ID NO: 208809 - DNA, 25 bp, E. coli
ggcaacaagcagcaatctcagcgct

SEQ ID NO: 208810 - DNA, 25 bp, E. coli
ggcaacaagcaggaatctcagcgct

SEQ ID NO: 208811 - DNA, 25 bp, E. coli
gagtagtaaccaaagcagatttagc

SEQ ID NO: 208812 - DNA, 25 bp, E. coli
gagcgcacaacgagttagtaaccag

SEQ ID NO: 208813 - DNA, 25 bp, E. coli
gagcgcacaacgtgttagtaaccag

SEQ ID NO: 208814 - DNA, 25 bp, E. coli
gagtagtaaccatagcagatttagc

SEQ ID NO: 208815 - DNA, 25 bp, E. coli
aatatgttttagtcaacggccaggg

SEQ ID NO: 208816 - DNA, 25 bp, E. coli
caatacttacgcacaggtgcgcgag

SEQ ID NO: 208817 - DNA, 25 bp, E. coli
aatatgttttagacaacggccaggg

SEQ ID NO: 208818 - DNA, 25 bp, E. coli
caatacttacgctcaggtgcgcgag

SEQ ID NO: 208819 - DNA, 25 bp, E. coli
cattaagcgtcgctgaaaccctgcc

SEQ ID NO: 208820 - DNA, 25 bp, E. coli
cattaagcgtcggtgaaaccctgcc

SEQ ID NO: 208821 - DNA, 25 bp, E. coli
cagataactgcgtggaagcggcaca

SEQ ID NO: 208822 - DNA, 25 bp, E. coli
cagataactgcgaggaagcggcaca

SEQ ID NO: 208823 - DNA, 25 bp, E. coli
tgatggcccatgtcgatttgcacgc

SEQ ID NO: 208824 - DNA, 25 bp, E. coli
tgatggcccatgacgatttgcacgc

SEQ ID NO: 208825 - DNA, 25 bp, E. coli
tctggagtgcaacaaagcgtcgccg

SEQ ID NO: 208826 - DNA, 25 bp, E. coli
tcagaatgaggttcagccgagcacg

SEQ ID NO: 208827 - DNA, 25 bp, E. coli
tcagaatgaggtacagccgagcacg

SEQ ID NO: 208828 - DNA, 25 bp, E. coli
tctggagtgcaagaaagcgtcgccg

SEQ ID NO: 208829 - DNA, 25 bp, E. coli
gaataaagtatgaggcctgacgcgt

SEQ ID NO: 208830 - DNA, 25 bp, E. coli
gaataaagtatgtggcctgacgcgt

SEQ ID NO: 208831 - DNA, 25 bp, E. coli
gatacgctgcgtcaagctctgccag

SEQ ID NO: 208832 - DNA, 25 bp, E. coli
gatacgctgcgtgaagctctgccag

SEQ ID NO: 208833 - DNA, 25 bp, E. coli
tcaacgttgaactggcgcaggaagt

SEQ ID NO: 208834 - DNA, 25 bp, E. coli
taattctgctgttgagtcgcaaccg

SEQ ID NO: 208835 - DNA, 25 bp, E. coli
taattctgctgtagagtcgcaaccg

SEQ ID NO: 208836 - DNA, 25 bp, E. coli
tcaacgttgaacaggcgcaggaagt

SEQ ID NO: 208837 - DNA, 25 bp, E. coli
tacttaactttggtgcccgagacag

SEQ ID NO: 208838 - DNA, 25 bp, E. coli
tacttaactttgctgcccgagacag

SEQ ID NO: 208839 - DNA, 25 bp, E. coli
tgtatgtagattagttcgacaacgc

SEQ ID NO: 208840 - DNA, 25 bp, E. coli
tgtatgtagatttgttcgacaacgc

SEQ ID NO: 208841 - DNA, 25 bp, E. coli
tgagatgccccgatcctggagatat

SEQ ID NO: 208842 - DNA, 25 bp, E. coli
tgagatgccccgttcctggagatat

SEQ ID NO: 208843 - DNA, 25 bp, E. coli
ttcgcggtcatccaaactaatttaa

SEQ ID NO: 208844 - DNA, 25 bp, E. coli
ttcgcggtcatcgaaactaatttaa

SEQ ID NO: 208845 - DNA, 25 bp, E. coli
tctgaaaatagatgataatagggcg

SEQ ID NO: 208846 - DNA, 25 bp, E. coli
tctgaaaatagaagataatagggcg

SEQ ID NO: 208847 - DNA, 25 bp, E. coli
cctcttttgtcgtatggtcgccgcg

SEQ ID NO: 208848 - DNA, 25 bp, E. coli
ccttctgataattgttaaccctggg

SEQ ID NO: 208849 - DNA, 25 bp, E. coli
ccttctgataatagttaaccctggg

SEQ ID NO: 208850 - DNA, 25 bp, E. coli
cctcttttgtcgaatggtcgccgcg

SEQ ID NO: 208851 - DNA, 25 bp, E. coli
gacaacgctttaaagtacccttctg

SEQ ID NO: 208852 - DNA, 25 bp, E. coli
gacaacgctttatagtacccttctg

SEQ ID NO: 208853 - DNA, 25 bp, E. coli
cgagacagcactgatttcgcggtca

SEQ ID NO: 208854 - DNA, 25 bp, E. coli
cgagacagcactcatttcgcggtca

SEQ ID NO: 208855 - DNA, 25 bp, E. coli
ggtcgccgcggattctacttaactt

SEQ ID NO: 208856 - DNA, 25 bp, E. coli
ggtcgccgcggaatctacttaactt

SEQ ID NO: 208857 - DNA, 25 bp, E. coli
taatagggcgtgtctgtatgtagat

SEQ ID NO: 208858 - DNA, 25 bp, E. coli
taatagggcgtgactgtatgtagat

SEQ ID NO: 208859 - DNA, 25 bp, E. coli
aagcttggccttgaaatcgacggcg

SEQ ID NO: 208860 - DNA, 25 bp, E. coli
aagcttggccttcaaatcgacggcg

SEQ ID NO: 208861 - DNA, 25 bp, E. coli
caccggacggataccggcattaatt

SEQ ID NO: 208862 - DNA, 25 bp, E. coli
caccggacggattccggcattaatt

SEQ ID NO: 208863 - DNA, 25 bp, E. coli
acttaagctattagccactgatgca

SEQ ID NO: 208864 - DNA, 25 bp, E. coli
acttaagctatttgccactgatgca

SEQ ID NO: 208865 - DNA, 25 bp, E. coli
tatcgattctgcaactaggtaaaga

SEQ ID NO: 208866 - DNA, 25 bp, E. coli
tatcgattctgctactaggtaaaga

SEQ ID NO: 208867 - DNA, 25 bp, E. coli
tttaccaagcttggccttgaaatcg

SEQ ID NO: 208868 - DNA, 25 bp, E. coli
tttaccaagcttcgccttgaaatcg

SEQ ID NO: 208869 - DNA, 25 bp, E. coli
tcgctcaccggacggataccggcat

SEQ ID NO: 208870 - DNA, 25 bp, E. coli
tcgctcaccggagggataccggcat

SEQ ID NO: 208871 - DNA, 25 bp, E. coli
gccgacttaagctatttgccactga

SEQ ID NO: 208872 - DNA, 25 bp, E. coli
gccgacttaagcaatttgccactga

SEQ ID NO: 208873 - DNA, 25 bp, E. coli
gcaactaggtaatgatttagatcgc

SEQ ID NO: 208874 - DNA, 25 bp, E. coli
gcaactaggtaaagatttagatcgc

SEQ ID NO: 208875 - DNA, 25 bp, E. coli
gacggataccggcattaattgaaag

SEQ ID NO: 208876 - DNA, 25 bp, E. coli
ctaggtaaagatttagatcgcttca

SEQ ID NO: 208877 - DNA, 25 bp, E. coli
ctaggtaaagatatagatcgcttca

SEQ ID NO: 208878 - DNA, 25 bp, E. coli
gatcgcttcaaatatctggtcctgg

SEQ ID NO: 208879 - DNA, 25 bp, E. coli
gacggataccgggattaattgaaag

SEQ ID NO: 208880 - DNA, 25 bp, E. coli
gatcgcttcaaaaatctggtcctgg

SEQ ID NO: 208881 - DNA, 25 bp, E. coli
caagtttttatcatgcgtcacggcg

SEQ ID NO: 208882 - DNA, 25 bp, E. coli
aatcgaacgcgtactggtgagcccg

SEQ ID NO: 208883 - DNA, 25 bp, E. coli
caagtttttatcttgcgtcacggcg

SEQ ID NO: 208884 - DNA, 25 bp, E. coli
aatcgaacgcgttctggtgagcccg

SEQ ID NO: 208885 - DNA, 25 bp, E. coli
cagcgtaacgcttgatgaaagcgga

SEQ ID NO: 208886 - DNA, 25 bp, E. coli
cagcgtaacgctagatgaaagcgga

SEQ ID NO: 208887 - DNA, 25 bp, E. coli
tatttgcaggcgatgaccaatgaag

SEQ ID NO: 208888 - DNA, 25 bp, E. coli
tatttgcaggcgttgaccaatgaag

SEQ ID NO: 208889 - DNA, 25 bp, E. coli
ttcctgcgagcccagcaaacactgg

SEQ ID NO: 208890 - DNA, 25 bp, E. coli
ttcctgcgagccgagcaaacactgg

SEQ ID NO: 208891 - DNA, 25 bp, E. coli
ttgtgacgaatctcgcctgatggcg

SEQ ID NO: 208892 - DNA, 25 bp, E. coli
ttgtgacgaatcacgcctgatggcg

SEQ ID NO: 208893 - DNA, 25 bp, E. coli
tgaacctgccttccagtgcagaagt

SEQ ID NO: 208894 - DNA, 25 bp, E. coli
tgaacctgccttgcagtgcagaagt

SEQ ID NO: 208895 - DNA, 25 bp, E. coli
gctgaaaggtcataaagtggaaatc

SEQ ID NO: 208896 - DNA, 25 bp, E. coli
gctgaaaggtcaaaaagtggaaatc

SEQ ID NO: 208897 - DNA, 25 bp, E. coli
gaagttctgccggagttaacgccct

SEQ ID NO: 208898 - DNA, 25 bp, E. coli
gaagttctgccgcagttaacgccct

SEQ ID NO: 208899 - DNA, 25 bp, E. coli
ctgatggcgaactggctgaaaggtc

SEQ ID NO: 208900 - DNA, 25 bp, E. coli
ctgatggcgaacaggctgaaaggtc

SEQ ID NO: 208901 - DNA, 25 bp, E. coli
gtccgggcgaaaggccgcctatgtt

SEQ ID NO: 208902 - DNA, 25 bp, E. coli
gtccgggcgaaacgccgcctatgtt

SEQ ID NO: 208903 - DNA, 25 bp, E. coli
caatagcgacggtgagttaggttat

SEQ ID NO: 208904 - DNA, 25 bp, E. coli
caagggtgataaactcaaatacagc

SEQ ID NO: 208905 - DNA, 25 bp, E. coli
caatagcgacggagagttaggttat

SEQ ID NO: 208906 - DNA, 25 bp, E. coli
caagggtgataatctcaaatacagc

SEQ ID NO: 208907 - DNA, 25 bp, E. coli
caaacgactttttgtataaccacag

SEQ ID NO: 208908 - DNA, 25 bp, E. coli
caaacgacttttagtataaccacag

SEQ ID NO: 208909 - DNA, 25 bp, E. coli
catgcaggattgtttatgaactcta

SEQ ID NO: 208910 - DNA, 25 bp, E. coli
catgcaggattgattatgaactcta

SEQ ID NO: 208911 - DNA, 25 bp, E. coli
tagaactggttacaatagcgacgga

SEQ ID NO: 208912 - DNA, 25 bp, E. coli
tagaactggttagaatagcgacgga

SEQ ID NO: 208913 - DNA, 25 bp, E. coli
tattcaggaattctcagataggcct

SEQ ID NO: 208914 - DNA, 25 bp, E. coli
tattccatggacttcatttactggg

SEQ ID NO: 208915 - DNA, 25 bp, E. coli
tattccatggacatcatttactggg

SEQ ID NO: 208916 - DNA, 25 bp, E. coli
tattcaggaattgtcagataggcct

SEQ ID NO: 208917 - DNA, 25 bp, E. coli
tcagataggcctaatgactggcttt

SEQ ID NO: 208918 - DNA, 25 bp, E. coli
tctacccattattacagcaggaaaa

SEQ ID NO: 208919 - DNA, 25 bp, E. coli
tctacccattataacagcaggaaaa

SEQ ID NO: 208920 - DNA, 25 bp, E. coli
tcagataggccttatgactggcttt

SEQ ID NO: 208921 - DNA, 25 bp, E. coli
cattctctggtatttggactcctgt

SEQ ID NO: 208922 - DNA, 25 bp, E. coli
cattctctggtaattggactcctgt

SEQ ID NO: 208923 - DNA, 25 bp, E. coli
ggactcctgtaaagaatgacttcaa

SEQ ID NO: 208924 - DNA, 25 bp, E. coli
ggactcctgtaatgaatgacttcaa

SEQ ID NO: 208925 - DNA, 25 bp, E. coli
acgaactggatcaggcatggctgcc

SEQ ID NO: 208926 - DNA, 25 bp, E. coli
acgaactggatctggcatggctgcc

SEQ ID NO: 208927 - DNA, 25 bp, E. coli
tgcagggtctgaacaaagcggaaac

SEQ ID NO: 208928 - DNA, 25 bp, E. coli
tgcagggtctgatcaaagcggaaac

SEQ ID NO: 208929 - DNA, 25 bp, E. coli
tccgcgttacgcgaaactgagcgag

SEQ ID NO: 208930 - DNA, 25 bp, E. coli
tccgcgttacgccaaactgagcgag

SEQ ID NO: 208931 - DNA, 25 bp, E. coli
tcgtcatggcgaaagtcagtggaac

SEQ ID NO: 208932 - DNA, 25 bp, E. coli
tcgtcatggcgatagtcagtggaac

SEQ ID NO: 208933 - DNA, 25 bp, E. coli
tctgtctgagaatggcgtaagcgaa

SEQ ID NO: 208934 - DNA, 25 bp, E. coli
tctgtctgagaaaggcgtaagcgaa

SEQ ID NO: 208935 - DNA, 25 bp, E. coli
gactccgccggatctgactaaagat

SEQ ID NO: 208936 - DNA, 25 bp, E. coli
gactccgccggaactgactaaagat

SEQ ID NO: 208937 - DNA, 25 bp, E. coli
gaaatcctggaaactgaacgaacgt

SEQ ID NO: 208938 - DNA, 25 bp, E. coli
gaaatcctggaatctgaacgaacgt

SEQ ID NO: 208939 - DNA, 25 bp, E. coli
cgtaagcgaagctaaagcagcaggt

SEQ ID NO: 208940 - DNA, 25 bp, E. coli
cgtaagcgaagcaaaagcagcaggt

SEQ ID NO: 208941 - DNA, 25 bp, E. coli
cattgaccgcgtgatcccttactgg

SEQ ID NO: 208942 - DNA, 25 bp, E. coli
cattgaccgcgtcatcccttactgg

SEQ ID NO: 208943 - DNA, 25 bp, E. coli
tggctgcccgttcagaaatcctgga

SEQ ID NO: 208944 - DNA, 25 bp, E. coli
tggctgcccgttgagaaatcctgga

SEQ ID NO: 208945 - DNA, 25 bp, E. coli
taagctggttctggttcgtcatggc

SEQ ID NO: 208946 - DNA, 25 bp, E. coli
taagctggttctcgttcgtcatggc

SEQ ID NO: 208947 - DNA, 25 bp, E. coli
caaaagttgggcttgcttgcgctaa

SEQ ID NO: 208948 - DNA, 25 bp, E. coli
caaaagttgggcatgcttgcgctaa

SEQ ID NO: 208949 - DNA, 25 bp, E. coli
tacttttctaaccatgcctggcttg

SEQ ID NO: 208950 - DNA, 25 bp, E. coli
tacttttctaacgatgcctggcttg

SEQ ID NO: 208951 - DNA, 25 bp, E. coli
taaacgcgacgtcggtaaagccaca

SEQ ID NO: 208952 - DNA, 25 bp, E. coli
taaacgcgacgtgggtaaagccaca

SEQ ID NO: 208953 - DNA, 25 bp, E. coli
tatctggcgatgcttccggtgctgc

SEQ ID NO: 208954 - DNA, 25 bp, E. coli
tatctggcgatggttccggtgctgc

SEQ ID NO: 208955 - DNA, 25 bp, E. coli
tttatgaagtacaccacgttcgcag

SEQ ID NO: 208956 - DNA, 25 bp, E. coli
tttatgaagtactccacgttcgcag

SEQ ID NO: 208957 - DNA, 25 bp, E. coli
tccaccgccggtattctgaagattg

SEQ ID NO: 208958 - DNA, 25 bp, E. coli
tcgattaacatcctcggcacgctgg

SEQ ID NO: 208959 - DNA, 25 bp, E. coli
tcgattaacatcgtcggcacgctgg

SEQ ID NO: 208960 - DNA, 25 bp, E. coli
tccaccgccggttttctgaagattg

SEQ ID NO: 208961 - DNA, 25 bp, E. coli
ccggtggcgatagcatggatagtct

SEQ ID NO: 208962 - DNA, 25 bp, E. coli
ccggtggcgataccatggatagtct

SEQ ID NO: 208963 - DNA, 25 bp, E. coli
cattgtcgtgagctcgatgatcggc

SEQ ID NO: 208964 - DNA, 25 bp, E. coli
cattgtcgtgaggtcgatgatcggc

SEQ ID NO: 208965 - DNA, 25 bp, E. coli
gatttcggtgctaaccagctggctg

SEQ ID NO: 208966 - DNA, 25 bp, E. coli
gatttcggtgcttaccagctggctg

SEQ ID NO: 208967 - DNA, 25 bp, E. coli
ggcactctggaggttcatcggcgtt

SEQ ID NO: 208968 - DNA, 25 bp, E. coli
ggcactctggagcttcatcggcgtt

SEQ ID NO: 208969 - DNA, 25 bp, E. coli
caacgcctctttacagcggagtgca

SEQ ID NO: 208970 - DNA, 25 bp, E. coli
caacgcctcttttcagcggagtgca

SEQ ID NO: 208971 - DNA, 25 bp, E. coli
taaacaggtattcggtcaggagttc

SEQ ID NO: 208972 - DNA, 25 bp, E. coli
taaacaggtattgggtcaggagttc

SEQ ID NO: 208973 - DNA, 25 bp, E. coli
tgttctgctcaggaagctgtgcgct

SEQ ID NO: 208974 - DNA, 25 bp, E. coli
tgttctgctcagcaagctgtgcgct

SEQ ID NO: 208975 - DNA, 25 bp, E. coli
tgttgaccagcaaggaagccagcga

SEQ ID NO: 208976 - DNA, 25 bp, E. coli
tgttgaccagcatggaagccagcga

SEQ ID NO: 208977 - DNA, 25 bp, E. coli
tccgtttggcaatgatgcaccgctt

SEQ ID NO: 208978 - DNA, 25 bp, E. coli
tccgtttggcaaagatgcaccgctt

SEQ ID NO: 208979 - DNA, 25 bp, E. coli
tcgacaagatcgtcccacgcgattg

SEQ ID NO: 208980 - DNA, 25 bp, E. coli
tcgacaagatcgacccacgcgattg

SEQ ID NO: 208981 - DNA, 25 bp, E. coli
gcactgacgcaataatgtggccttg

SEQ ID NO: 208982 - DNA, 25 bp, E. coli
gcactgacgcaaaaatgtggccttg

SEQ ID NO: 208983 - DNA, 25 bp, E. coli
cgattgtcgtctgaaggtcggcaaa

SEQ ID NO: 208984 - DNA, 25 bp, E. coli
cgattgtcgtctcaaggtcggcaaa

SEQ ID NO: 208985 - DNA, 25 bp, E. coli
tggtcgcccggttacgcaatcggta

SEQ ID NO: 208986 - DNA, 25 bp, E. coli
tggtcgcccggtaacgcaatcggta

SEQ ID NO: 208987 - DNA, 25 bp, E. coli
gagttcaaactggttacgccgggca

SEQ ID NO: 208988 - DNA, 25 bp, E. coli
gacgctgaaagccatcaacgcctct

SEQ ID NO: 208989 - DNA, 25 bp, E. coli
gagttcaaactgcttacgccgggca

SEQ ID NO: 208990 - DNA, 25 bp, E. coli
gacgctgaaagcgatcaacgcctct

SEQ ID NO: 208991 - DNA, 25 bp, E. coli
aagagtggcagcttcgtttacaggc

SEQ ID NO: 208992 - DNA, 25 bp, E. coli
aactgaaacactcgcagcgctgggc

SEQ ID NO: 208993 - DNA, 25 bp, E. coli
aagagtggcagcatcgtttacaggc

SEQ ID NO: 208994 - DNA, 25 bp, E. coli
cagctgtcgtttttgccgatggccc

SEQ ID NO: 208995 - DNA, 25 bp, E. coli
cagctgtcgtttatgccgatggccc

SEQ ID NO: 208996 - DNA, 25 bp, E. coli
catgcgacgggccatagagtcttga

SEQ ID NO: 208997 - DNA, 25 bp, E. coli
catgcgacgggcgatagagtcttga

SEQ ID NO: 208998 - DNA, 25 bp, E. coli
tacatgacccattaaccgggctggc

SEQ ID NO: 208999 - DNA, 25 bp, E. coli
tacagtcggaatctgaagtgcagca

SEQ ID NO: 209000 - DNA, 25 bp, E. coli
tacagtcggaatgtgaagtgcagca

SEQ ID NO: 209001 - DNA, 25 bp, E. coli
tacatgacccataaaccgggctggc

SEQ ID NO: 209002 - DNA, 25 bp, E. coli
aaaaatgcgcaggttctacgtaccg

SEQ ID NO: 209003 - DNA, 25 bp, E. coli
aactgaaacactggcagcgctgggc

SEQ ID NO: 209004 - DNA, 25 bp, E. coli
aaaaatgcgcagcttctacgtaccg

SEQ ID NO: 209005 - DNA, 25 bp, E. coli
gaacgtatcgctgagtttcaccgct

SEQ ID NO: 209006 - DNA, 25 bp, E. coli
gaacgtatcgctcagtttcaccgct

SEQ ID NO: 209007 - DNA, 25 bp, E. coli
tggcgggctgcgacataaagcatac

SEQ ID NO: 209008 - DNA, 25 bp, E. coli
tggcgggctgcgtcataaagcatac

SEQ ID NO: 209009 - DNA, 25 bp, E. coli
taagcgccccacgtttaaaagagca

SEQ ID NO: 209010 - DNA, 25 bp, E. coli
taagcgccccacctttaaaagagca

SEQ ID NO: 209011 - DNA, 25 bp, E. coli
gaccggttgtatactgctggcatca

SEQ ID NO: 209012 - DNA, 25 bp, E. coli
gaccggttgtattctgctggcatca

SEQ ID NO: 209013 - DNA, 25 bp, E. coli
aagtcgcggcggagcatgaagccat

SEQ ID NO: 209014 - DNA, 25 bp, E. coli
aagtcgcggcggtgcatgaagccat

SEQ ID NO: 209015 - DNA, 25 bp, E. coli
tatgccgacgtagccagtaaaagcg

SEQ ID NO: 209016 - DNA, 25 bp, E. coli
tatgccgacgtacccagtaaaagcg

SEQ ID NO: 209017 - DNA, 25 bp, E. coli
tgccctcagcatatcaccacattgg

SEQ ID NO: 209018 - DNA, 25 bp, E. coli
tgccctcagcatttcaccacattgg

SEQ ID NO: 209019 - DNA, 25 bp, E. coli
ttggccatttttcgcgaagtcgcgg

SEQ ID NO: 209020 - DNA, 25 bp, E. coli
ttggccatttttggcgaagtcgcgg

SEQ ID NO: 209021 - DNA, 25 bp, E. coli
ccatgcgaatcattgaggaagacga

SEQ ID NO: 209022 - DNA, 25 bp, E. coli
ccatgcgaatcaatgaggaagacga

SEQ ID NO: 209023 - DNA, 25 bp, E. coli
gctatgttgaaacggcgtatgcccg

SEQ ID NO: 209024 - DNA, 25 bp, E. coli
gctatgttgaaagggcgtatgcccg

SEQ ID NO: 209025 - DNA, 25 bp, E. coli
gaaatctttggctgttgccctcagc

SEQ ID NO: 209026 - DNA, 25 bp, E. coli
gaaatctttggcagttgccctcagc

SEQ ID NO: 209027 - DNA, 25 bp, E. coli
gaaaaaacgaatgataaacgcaccg

SEQ ID NO: 209028 - DNA, 25 bp, E. coli
gaaaaaacgaatcataaacgcaccg

SEQ ID NO: 209029 - DNA, 25 bp, E. coli
gatttgattcgcttcgacgccattg

SEQ ID NO: 209030 - DNA, 25 bp, E. coli
gatttgattcgcatcgacgccattg

SEQ ID NO: 209031 - DNA, 25 bp, E. coli
tggtttgttaattctgccggttccg

SEQ ID NO: 209032 - DNA, 25 bp, E. coli
tggtttgttaatactgccggttccg

SEQ ID NO: 209033 - DNA, 25 bp, E. coli
taaaagcgccaatgtggtggtatca

SEQ ID NO: 209034 - DNA, 25 bp, E. coli
taaaagcgccaaagtggtggtatca

SEQ ID NO: 209035 - DNA, 25 bp, E. coli
caacagtctccatatatttccgtag

SEQ ID NO: 209036 - DNA, 25 bp, E. coli
caacagtctccaaatatttccgtag

SEQ ID NO: 209037 - DNA, 25 bp, E. coli
cactctggccgaagcagtcaatttt

SEQ ID NO: 209038 - DNA, 25 bp, E. coli
cactctggccgatgcagtcaatttt

SEQ ID NO: 209039 - DNA, 25 bp, E. coli
cagaggattttcgtggcaacaacag

SEQ ID NO: 209040 - DNA, 25 bp, E. coli
cagaggattttcctggcaacaacag

SEQ ID NO: 209041 - DNA, 25 bp, E. coli
tacaatttcgcaggcggcgaagccc

SEQ ID NO: 209042 - DNA, 25 bp, E. coli
tacaatttcgcacgcggcgaagccc

SEQ ID NO: 209043 - DNA, 25 bp, E. coli
tagatattctgccagcaaggcgctc

SEQ ID NO: 209044 - DNA, 25 bp, E. coli
tatcgatgctggtatcactctggcc

SEQ ID NO: 209045 - DNA, 25 bp, E. coli
taccggcttgcttaaaactaatgtg

SEQ ID NO: 209046 - DNA, 25 bp, E. coli
taccggcttgctaaaaactaatgtg

SEQ ID NO: 209047 - DNA, 25 bp, E. coli
tagatattctgcgagcaaggcgctc

SEQ ID NO: 209048 - DNA, 25 bp, E. coli
tatcgatgctggaatcactctggcc

SEQ ID NO: 209049 - DNA, 25 bp, E. coli
tctggtggaaaactacgaactggta

SEQ ID NO: 209050 - DNA, 25 bp, E. coli
tctggtggaaaagtacgaactggta

SEQ ID NO: 209051 - DNA, 25 bp, E. coli
cctgctggaacaacactatggcctg

SEQ ID NO: 209052 - DNA, 25 bp, E. coli
cctgctggaacatcactatggcctg

SEQ ID NO: 209053 - DNA, 25 bp, E. coli
gaactggtacgtttcgatcacagag

SEQ ID NO: 209054 - DNA, 25 bp, E. coli
gaactggtacgtatcgatcacagag

SEQ ID NO: 209055 - DNA, 25 bp, E. coli
ctatggcctgacactgaacgacacg

SEQ ID NO: 209056 - DNA, 25 bp, E. coli
ctatggcctgactctgaacgacacg

SEQ ID NO: 209057 - DNA, 25 bp, E. coli
caccattataaatttatcgctgttt

SEQ ID NO: 209058 - DNA, 25 bp, E. coli
caccattataaaattatcgctgttt

SEQ ID NO: 209059 - DNA, 25 bp, E. coli
cattataaaattatcgctgttttgc

SEQ ID NO: 209060 - DNA, 25 bp, E. coli
cattataaaattttcgctgttttgc

SEQ ID NO: 209061 - DNA, 25 bp, E. coli
tatgccagaatcataaaaaagcagg

SEQ ID NO: 209062 - DNA, 25 bp, E. coli
tatcgctgttttccggtacgctatc

SEQ ID NO: 209063 - DNA, 25 bp, E. coli
tatcgctgttttgcggtacgctatc

SEQ ID NO: 209064 - DNA, 25 bp, E. coli
tatgccagaatcttaaaaaagcagg

SEQ ID NO: 209065 - DNA, 25 bp, E. coli
tgccaccattataaaattatcgctg

SEQ ID NO: 209066 - DNA, 25 bp, E. coli
tgccaccattattaaattatcgctg

SEQ ID NO: 209067 - DNA, 25 bp, E. coli
tcatgccaccataataaaattatcg

SEQ ID NO: 209068 - DNA, 25 bp, E. coli
tcatgccaccattataaaattatcg

SEQ ID NO: 209069 - DNA, 25 bp, E. coli
gccaccattatataattatcgctgt

SEQ ID NO: 209070 - DNA, 25 bp, E. coli
gccaccattataaaattatcgctgt

SEQ ID NO: 209071 - DNA, 25 bp, E. coli
gcgtcttatcatgccaccattataa

SEQ ID NO: 209072 - DNA, 25 bp, E. coli
gcgtcttatcatcccaccattataa

SEQ ID NO: 209073 - DNA, 25 bp, E. coli
cgctgttttgcggtacgctatcgcc

SEQ ID NO: 209074 - DNA, 25 bp, E. coli
cgctgttttgcgctacgctatcgcc

SEQ ID NO: 209075 - DNA, 25 bp, E. coli
gtcttatcatgccaccattataaaa

SEQ ID NO: 209076 - DNA, 25 bp, E. coli
ggttatgccagaatcataaaaaagc

SEQ ID NO: 209077 - DNA, 25 bp, E. coli
gtcttatcatgcgaccattataaaa

SEQ ID NO: 209078 - DNA, 25 bp, E. coli
ggttatgccagattcataaaaaagc

SEQ ID NO: 209079 - DNA, 25 bp, E. coli
catgcattgaagaacagctgggatc

SEQ ID NO: 209080 - DNA, 25 bp, E. coli
catgcattgaagtacagctgggatc

SEQ ID NO: 209081 - DNA, 25 bp, E. coli
aaaaactcagggtaactatccagcg

SEQ ID NO: 209082 - DNA, 25 bp, E. coli
aaagcaggatcgaccatcttcacgc

SEQ ID NO: 209083 - DNA, 25 bp, E. coli
aaagcaggatcgtccatcttcacgc

SEQ ID NO: 209084 - DNA, 25 bp, E. coli
aaaataaagatctgcgcggtgtggt

SEQ ID NO: 209085 - DNA, 25 bp, E. coli
aaaataaagatcagcgcggtgtggt

SEQ ID NO: 209086 - DNA, 25 bp, E. coli
aaaaactcagggaaactatccagcg

SEQ ID NO: 209087 - DNA, 25 bp, E. coli
tatccagcgacgtaacgcattcttg

SEQ ID NO: 209088 - DNA, 25 bp, E. coli
tatccagcgacgaaacgcattcttg

SEQ ID NO: 209089 - DNA, 25 bp, E. coli
ttgtctggacgaccaggttatccgt

SEQ ID NO: 209090 - DNA, 25 bp, E. coli
ttgtctggacgagcaggttatccgt

SEQ ID NO: 209091 - DNA, 25 bp, E. coli
tggtgcagacatcaatatgatcgcc

SEQ ID NO: 209092 - DNA, 25 bp, E. coli
tgtggtgtttatgtccgcgaaaccg

SEQ ID NO: 209093 - DNA, 25 bp, E. coli
tggtgcagacatgaatatgatcgcc

SEQ ID NO: 209094 - DNA, 25 bp, E. coli
tgtggtgtttatctccgcgaaaccg

SEQ ID NO: 209095 - DNA, 25 bp, E. coli
gaagcagtacgttgtctggacgagc

SEQ ID NO: 209096 - DNA, 25 bp, E. coli
gaagcagtacgtagtctggacgagc

SEQ ID NO: 209097 - DNA, 25 bp, E. coli
cgtttagtcgagttgagcaagcgtg

SEQ ID NO: 209098 - DNA, 25 bp, E. coli
cgtttagtcgagatgagcaagcgtg

SEQ ID NO: 209099 - DNA, 25 bp, E. coli
ggacaactttatggctggtgcagac

SEQ ID NO: 209100 - DNA, 25 bp, E. coli
ggacaactttatcgctggtgcagac

SEQ ID NO: 209101 - DNA, 25 bp, E. coli
aatgataccgtctcttgcccgaagc

SEQ ID NO: 209102 - DNA, 25 bp, E. coli
aatgataccgtcacttgcccgaagc

SEQ ID NO: 209103 - DNA, 25 bp, E. coli
catggctgtaaatgcgcctgcggct

SEQ ID NO: 209104 - DNA, 25 bp, E. coli
catggctgtaaaagcgcctgcggct

SEQ ID NO: 209105 - DNA, 25 bp, E. coli
aaaatgtggtagaactcaatgacgc

SEQ ID NO: 209106 - DNA, 25 bp, E. coli
aaaatgtggtagtactcaatgacgc

SEQ ID NO: 209107 - DNA, 25 bp, E. coli
tattcagggaaaaaaggctgcactg

SEQ ID NO: 209108 - DNA, 25 bp, E. coli
tattcagggaaataaggctgcactg

SEQ ID NO: 209109 - DNA, 25 bp, E. coli
tgcccgaagcatggtactaacccaa

SEQ ID NO: 209110 - DNA, 25 bp, E. coli
tgcccgaagcatcgtactaacccaa

SEQ ID NO: 209111 - DNA, 25 bp, E. coli
tctcacggtggctaagtctcttcgg

SEQ ID NO: 209112 - DNA, 25 bp, E. coli
tctcacggtggcaaagtctcttcgg

SEQ ID NO: 209113 - DNA, 25 bp, E. coli
gctcggtggtgtttgccagtctgcc

SEQ ID NO: 209114 - DNA, 25 bp, E. coli
gctcggtggtgtatgccagtctgcc

SEQ ID NO: 209115 - DNA, 25 bp, E. coli
cccaattgtggagtgtgataccagt

SEQ ID NO: 209116 - DNA, 25 bp, E. coli
cccaattgtggactgtgataccagt

SEQ ID NO: 209117 - DNA, 25 bp, E. coli
gtctcttcggcctcttcaacctttg

SEQ ID NO: 209118 - DNA, 25 bp, E. coli
gtctcttcggccacttcaacctttg

SEQ ID NO: 209119 - DNA, 25 bp, E. coli
ggctgcactgctgaatgataccgtc

SEQ ID NO: 209120 - DNA, 25 bp, E. coli
ggctgcactgctcaatgataccgtc

SEQ ID NO: 209121 - DNA, 25 bp, E. coli
tcaatgacgcaacttctcacggtgg

SEQ ID NO: 209122 - DNA, 25 bp, E. coli
tcaatgacgcaagttctcacggtgg

SEQ ID NO: 209123 - DNA, 25 bp, E. coli
aatattctgagtacgtttgagcagc

SEQ ID NO: 209124 - DNA, 25 bp, E. coli
aatattctgagttcgtttgagcagc

SEQ ID NO: 209125 - DNA, 25 bp, E. coli
catctggacgatgacatccggtctc

SEQ ID NO: 209126 - DNA, 25 bp, E. coli
catctggacgatcacatccggtctc

SEQ ID NO: 209127 - DNA, 25 bp, E. coli
atgtctgcaatcacagtctcccgtc

SEQ ID NO: 209128 - DNA, 25 bp, E. coli
atgtctgcaatctcagtctcccgtc

SEQ ID NO: 209129 - DNA, 25 bp, E. coli
atctggacgatctcatccggtctct

SEQ ID NO: 209130 - DNA, 25 bp, E. coli
atctggacgatcacatccggtctct

SEQ ID NO: 209131 - DNA, 25 bp, E. coli
tcagtgaagagattattctgagtac

SEQ ID NO: 209132 - DNA, 25 bp, E. coli
tcagtgaagagaatattctgagtac

SEQ ID NO: 209133 - DNA, 25 bp, E. coli
gcaatcacagtctcccgtccggaag

SEQ ID NO: 209134 - DNA, 25 bp, E. coli
gcaatcacagtcacccgtccggaag

SEQ ID NO: 209135 - DNA, 25 bp, E. coli
cgatcacatccggtctcttcaggga

SEQ ID NO: 209136 - DNA, 25 bp, E. coli
cgatcacatccgctctcttcaggga

SEQ ID NO: 209137 - DNA, 25 bp, E. coli
gttgctggctgactgagaaaccgga

SEQ ID NO: 209138 - DNA, 25 bp, E. coli
gttgctggctgagtgagaaaccgga

SEQ ID NO: 209139 - DNA, 25 bp, E. coli
gtggttgctggcagactgagaaacc

SEQ ID NO: 209140 - DNA, 25 bp, E. coli
gtggttgctggctgactgagaaacc

SEQ ID NO: 209141 - DNA, 25 bp, E. coli
tggttgctggctgactgagaaaccg

SEQ ID NO: 209142 - DNA, 25 bp, E. coli
tggttgctggctcactgagaaaccg

SEQ ID NO: 209143 - DNA, 25 bp, E. coli
gagaatattctgtgtacgtttgagc

SEQ ID NO: 209144 - DNA, 25 bp, E. coli
gagaatattctgagtacgtttgagc

SEQ ID NO: 209145 - DNA, 25 bp, E. coli
aagagcagcttaatgccgcacgaga

SEQ ID NO: 209146 - DNA, 25 bp, E. coli
aagagcagcttattgccgcacgaga

SEQ ID NO: 209147 - DNA, 25 bp, E. coli
caaagagcagctaattgccgcacga

SEQ ID NO: 209148 - DNA, 25 bp, E. coli
caaagagcagcttattgccgcacga

SEQ ID NO: 209149 - DNA, 25 bp, E. coli
caccaaagagcagcttattgccgca

SEQ ID NO: 209150 - DNA, 25 bp, E. coli
caccaaagagcaccttattgccgca

SEQ ID NO: 209151 - DNA, 25 bp, E. coli
agagcagcttattgccgcacgagaa

SEQ ID NO: 209152 - DNA, 25 bp, E. coli
agagcagcttatagccgcacgagaa

SEQ ID NO: 209153 - DNA, 25 bp, E. coli
aaagagcagcttattgccgcacgag

SEQ ID NO: 209154 - DNA, 25 bp, E. coli
aaagagcagctttttgccgcacgag

SEQ ID NO: 209155 - DNA, 25 bp, E. coli
tattgccgcacgagaacatttcgcg

SEQ ID NO: 209156 - DNA, 25 bp, E. coli
tattgccgcacgtgaacatttcgcg

SEQ ID NO: 209157 - DNA, 25 bp, E. coli
ttgccgcacgagtacatttcgcgat

SEQ ID NO: 209158 - DNA, 25 bp, E. coli
ttgccgcacgagaacatttcgcgat

SEQ ID NO: 209159 - DNA, 25 bp, E. coli
ttattgccgcaccagaacatttcgc

SEQ ID NO: 209160 - DNA, 25 bp, E. coli
ttattgccgcacgagaacatttcgc

SEQ ID NO: 209161 - DNA, 25 bp, E. coli
tgccgcacgagatcatttcgcgatt

SEQ ID NO: 209162 - DNA, 25 bp, E. coli
tgccgcacgagaacatttcgcgatt

SEQ ID NO: 209163 - DNA, 25 bp, E. coli
gcttattgccgcacgagaacatttc

SEQ ID NO: 209164 - DNA, 25 bp, E. coli
gcttattgccgctcgagaacatttc

SEQ ID NO: 209165 - DNA, 25 bp, E. coli
gagcagcttattcccgcacgagaac

SEQ ID NO: 209166 - DNA, 25 bp, E. coli
gagcagcttattgccgcacgagaac

SEQ ID NO: 209167 - DNA, 25 bp, E. coli
cacagggttttagcgaagtttccag

SEQ ID NO: 209168 - DNA, 25 bp, E. coli
cacagggttttaccgaagtttccag

SEQ ID NO: 209169 - DNA, 25 bp, E. coli
cagacgctggcgaaggcaaatttgc

SEQ ID NO: 209170 - DNA, 25 bp, E. coli
cagacgctggcgtaggcaaatttgc

SEQ ID NO: 209171 - DNA, 25 bp, E. coli
taacgtcaatcacgatatcagcagc

SEQ ID NO: 209172 - DNA, 25 bp, E. coli
aaattcagctggacgccaacctggt

SEQ ID NO: 209173 - DNA, 25 bp, E. coli
aaattcagctggtcgccaacctggt

SEQ ID NO: 209174 - DNA, 25 bp, E. coli
tattacagcagatgaacctggccag

SEQ ID NO: 209175 - DNA, 25 bp, E. coli
tattacagcagaagaacctggccag

SEQ ID NO: 209176 - DNA, 25 bp, E. coli
tatcagcagcagtatgcagacgctg

SEQ ID NO: 209177 - DNA, 25 bp, E. coli
tatcagcagcagaatgcagacgctg

SEQ ID NO: 209178 - DNA, 25 bp, E. coli
tccgctaccgaccatggacaacatg

SEQ ID NO: 209179 - DNA, 25 bp, E. coli
tccgctaccgacgatggacaacatg

SEQ ID NO: 209180 - DNA, 25 bp, E. coli
tcatcagcatcaataaacagggtgt

SEQ ID NO: 209181 - DNA, 25 bp, E. coli
tcatcagcatcattaaacagggtgt

SEQ ID NO: 209182 - DNA, 25 bp, E. coli
gaagtttccagtagtcgacgtccgc

SEQ ID NO: 209183 - DNA, 25 bp, E. coli
gaagtttccagttgtcgacgtccgc

SEQ ID NO: 209184 - DNA, 25 bp, E. coli
gaaccgtcagtacaagcgtacgtga

SEQ ID NO: 209185 - DNA, 25 bp, E. coli
gaaccgtcagtagaagcgtacgtga

SEQ ID NO: 209186 - DNA, 25 bp, E. coli
ggacaacatgccaatcgaatcacgt

SEQ ID NO: 209187 - DNA, 25 bp, E. coli
ggacaacatgcctatcgaatcacgt

SEQ ID NO: 209188 - DNA, 25 bp, E. coli
taacgtcaatcaggatatcagcagc

SEQ ID NO: 209189 - DNA, 25 bp, E. coli
aatgtcgcctttaccggcggcagag

SEQ ID NO: 209190 - DNA, 25 bp, E. coli
aatgtcgccttttccggcggcagag

SEQ ID NO: 209191 - DNA, 25 bp, E. coli
aacggacgatggcaacggtgtacca

SEQ ID NO: 209192 - DNA, 25 bp, E. coli
aacggacgatgggaacggtgtacca

SEQ ID NO: 209193 - DNA, 25 bp, E. coli
tatcgtttcacaagttgccggcgct

SEQ ID NO: 209194 - DNA, 25 bp, E. coli
tatcgtttcacatgttgccggcgct

SEQ ID NO: 209195 - DNA, 25 bp, E. coli
tcgcagttgagatggtgattaccgc

SEQ ID NO: 209196 - DNA, 25 bp, E. coli
tcgcagttgagaaggtgattaccgc

SEQ ID NO: 209197 - DNA, 25 bp, E. coli
tccgaaagtcttagcctggctggcg

SEQ ID NO: 209198 - DNA, 25 bp, E. coli
tccgaaagtctttgcctggctggcg

SEQ ID NO: 209199 - DNA, 25 bp, E. coli
tcatcacattgtacgcggcagcgtt

SEQ ID NO: 209200 - DNA, 25 bp, E. coli
tcatcacattgttcgcggcagcgtt

SEQ ID NO: 209201 - DNA, 25 bp, E. coli
gcctgtttcgacaagcgcaaagtta

SEQ ID NO: 209202 - DNA, 25 bp, E. coli
ccttgaaaggccagtgcattgctga

SEQ ID NO: 209203 - DNA, 25 bp, E. coli
gcctgtttcgactagcgcaaagtta

SEQ ID NO: 209204 - DNA, 25 bp, E. coli
ccttgaaaggcctgtgcattgctga

SEQ ID NO: 209205 - DNA, 25 bp, E. coli
gctgatcctggccttaacggacgat

SEQ ID NO: 209206 - DNA, 25 bp, E. coli
gctgatcctggcgttaacggacgat

SEQ ID NO: 209207 - DNA, 25 bp, E. coli
cattgctgaattgctcggtaccggg

SEQ ID NO: 209208 - DNA, 25 bp, E. coli
cattgctgaattcctcggtaccggg

SEQ ID NO: 209209 - DNA, 25 bp, E. coli
gttttgccatgatcccagcgcgtga

SEQ ID NO: 209210 - DNA, 25 bp, E. coli
gttttgccatgaacccagcgcgtga

SEQ ID NO: 209211 - DNA, 25 bp, E. coli
aaccagttctccaggcacccggtat

SEQ ID NO: 209212 - DNA, 25 bp, E. coli
agttctcctggctcccggtatcgcg

SEQ ID NO: 209213 - DNA, 25 bp, E. coli
agcctcagaaatggcggccagtggc

SEQ ID NO: 209214 - DNA, 25 bp, E. coli
agagattagcggaaaagaagcctca

SEQ ID NO: 209215 - DNA, 25 bp, E. coli
agagattagcggtaaagaagcctca

SEQ ID NO: 209216 - DNA, 25 bp, E. coli
agcctcagaaatcgcggccagtggc

SEQ ID NO: 209217 - DNA, 25 bp, E. coli
agttctcctggcacccggtatcgcg

SEQ ID NO: 209218 - DNA, 25 bp, E. coli
aaccagttctcctggcacccggtat

SEQ ID NO: 209219 - DNA, 25 bp, E. coli
aaatcgcggccactggctgtgttcc

SEQ ID NO: 209220 - DNA, 25 bp, E. coli
acatggtcgggcaatctgttttgcc

SEQ ID NO: 209221 - DNA, 25 bp, E. coli
acatggtcgggctatctgttttgcc

SEQ ID NO: 209222 - DNA, 25 bp, E. coli
aaatcgcggccagtggctgtgttcc

SEQ ID NO: 209223 - DNA, 25 bp, E. coli
tgttccagcaaagcagttctcctgg

SEQ ID NO: 209224 - DNA, 25 bp, E. coli
tgttccagcaaaccagttctcctgg

SEQ ID NO: 209225 - DNA, 25 bp, E. coli
gccagtggctgtgttccagcaaacc

SEQ ID NO: 209226 - DNA, 25 bp, E. coli
gccagtggctgtcttccagcaaacc

SEQ ID NO: 209227 - DNA, 25 bp, E. coli
gcggcaagagattagcggtaaagaa

SEQ ID NO: 209228 - DNA, 25 bp, E. coli
gcggcaagagataagcggtaaagaa

SEQ ID NO: 209229 - DNA, 25 bp, E. coli
cggccagtggctctgttccagcaaa

SEQ ID NO: 209230 - DNA, 25 bp, E. coli
cggccagtggctgtgttccagcaaa

SEQ ID NO: 209231 - DNA, 25 bp, E. coli
gatgcggcaagagattagcggtaaa

SEQ ID NO: 209232 - DNA, 25 bp, E. coli
gatgcggcaagacattagcggtaaa

SEQ ID NO: 209233 - DNA, 25 bp, E. coli
caggatcgggcgtttatatacgaat

SEQ ID NO: 209234 - DNA, 25 bp, E. coli
caggatcgggcgattatatacgaat

SEQ ID NO: 209235 - DNA, 25 bp, E. coli
aactattaagcggtcaggatcgggc

SEQ ID NO: 209236 - DNA, 25 bp, E. coli
aactattaagcgctcaggatcgggc

SEQ ID NO: 209237 - DNA, 25 bp, E. coli
tatatataatatgaacgccgggaat

SEQ ID NO: 209238 - DNA, 25 bp, E. coli
tatatataatatcaacgccgggaat

SEQ ID NO: 209239 - DNA, 25 bp, E. coli
ttactttcttgttttgcggcggcgg

SEQ ID NO: 209240 - DNA, 25 bp, E. coli
ttactttcttgtattgcggcggcgg

SEQ ID NO: 209241 - DNA, 25 bp, E. coli
ccatggttgccagtaaaatggacaa

SEQ ID NO: 209242 - DNA, 25 bp, E. coli
ccatggttgccactaaaatggacaa

SEQ ID NO: 209243 - DNA, 25 bp, E. coli
gctgcggatgcttttcttgaaatac

SEQ ID NO: 209244 - DNA, 25 bp, E. coli
gctgcggatgctattcttgaaatac

SEQ ID NO: 209245 - DNA, 25 bp, E. coli
gactgtagcatgcatggtgtcaaga

SEQ ID NO: 209246 - DNA, 25 bp, E. coli
gactgtagcatggatggtgtcaaga

SEQ ID NO: 209247 - DNA, 25 bp, E. coli
ccgggaataacgagaaggttgctgc

SEQ ID NO: 209248 - DNA, 25 bp, E. coli
ccgggaataacgtgaaggttgctgc

SEQ ID NO: 209249 - DNA, 25 bp, E. coli
ggtgtcaagatataaccatggttgc

SEQ ID NO: 209250 - DNA, 25 bp, E. coli
ggtatatacctcaggcgcaagatgg

SEQ ID NO: 209251 - DNA, 25 bp, E. coli
ggtgtcaagataaaaccatggttgc

SEQ ID NO: 209252 - DNA, 25 bp, E. coli
ggtatatacctctggcgcaagatgg

SEQ ID NO: 209253 - DNA, 25 bp, E. coli
ggcggcggaccaaaaagcaatccag

SEQ ID NO: 209254 - DNA, 25 bp, E. coli
ggcggcggaccataaagcaatccag

SEQ ID NO: 209255 - DNA, 25 bp, E. coli
caatgtcatgactgtgtaggtgcgg

SEQ ID NO: 209256 - DNA, 25 bp, E. coli
aataaaaaccgccattgcaacaatg

SEQ ID NO: 209257 - DNA, 25 bp, E. coli
aataaaaaccgcgattgcaacaatg

SEQ ID NO: 209258 - DNA, 25 bp, E. coli
caatgtcatgacagtgtaggtgcgg

SEQ ID NO: 209259 - DNA, 25 bp, E. coli
catagggacgaggaatgtcatgaca

SEQ ID NO: 209260 - DNA, 25 bp, E. coli
catagggacgagcaatgtcatgaca

SEQ ID NO: 209261 - DNA, 25 bp, E. coli
taggtgcggttactgtcgtgaaaaa

SEQ ID NO: 209262 - DNA, 25 bp, E. coli
taggtgcggttagtgtcgtgaaaaa

SEQ ID NO: 209263 - DNA, 25 bp, E. coli
tatttgttacacttagggacgagca

SEQ ID NO: 209264 - DNA, 25 bp, E. coli
tatttgttacacatagggacgagca

SEQ ID NO: 209265 - DNA, 25 bp, E. coli
tgaaaaacaatataaaccgccattg

SEQ ID NO: 209266 - DNA, 25 bp, E. coli
tgaaaaacaataaaaaccgccattg

SEQ ID NO: 209267 - DNA, 25 bp, E. coli
tcatgacagtgttggtgcggttact

SEQ ID NO: 209268 - DNA, 25 bp, E. coli
tcatgacagtgtaggtgcggttact

SEQ ID NO: 209269 - DNA, 25 bp, E. coli
gcggttactgtcgtgaaaaacaata

SEQ ID NO: 209270 - DNA, 25 bp, E. coli
gcgcaattcggatgaagccctatga

SEQ ID NO: 209271 - DNA, 25 bp, E. coli
gcggttactgtcctgaaaaacaata

SEQ ID NO: 209272 - DNA, 25 bp, E. coli
gcgcaattcggaagaagccctatga

SEQ ID NO: 209273 - DNA, 25 bp, E. coli
gcaacaatggcgcaattcggatgaa

SEQ ID NO: 209274 - DNA, 25 bp, E. coli
gcaacaatggcggaattcggatgaa

SEQ ID NO: 209275 - DNA, 25 bp, E. coli
cggatgaagcccaatgacaaggata

SEQ ID NO: 209276 - DNA, 25 bp, E. coli
cggatgaagccctatgacaaggata

SEQ ID NO: 209277 - DNA, 25 bp, E. coli
caattaaaaggatatgttatgcata

SEQ ID NO: 209278 - DNA, 25 bp, E. coli
caattaaaaggaaatgttatgcata

SEQ ID NO: 209279 - DNA, 25 bp, E. coli
aagcggaaggaccagtaaagttgca

SEQ ID NO: 209280 - DNA, 25 bp, E. coli
taaaaggaaatgttatgcataagga

SEQ ID NO: 209281 - DNA, 25 bp, E. coli
taaaaggaaatgatatgcataagga

SEQ ID NO: 209282 - DNA, 25 bp, E. coli
actgaaagcggatggacgagtaaag

SEQ ID NO: 209283 - DNA, 25 bp, E. coli
actgaaagcggaaggacgagtaaag

SEQ ID NO: 209284 - DNA, 25 bp, E. coli
aagcggaaggacgagtaaagttgca

SEQ ID NO: 209285 - DNA, 25 bp, E. coli
ttgcaattaaaaggaaatgttatgc

SEQ ID NO: 209286 - DNA, 25 bp, E. coli
ttgcaattaaaacgaaatgttatgc

SEQ ID NO: 209287 - DNA, 25 bp, E. coli
gcggaaggacgagtaaagttgcaat

SEQ ID NO: 209288 - DNA, 25 bp, E. coli
gcggaaggacgactaaagttgcaat

SEQ ID NO: 209289 - DNA, 25 bp, E. coli
gaaggacgagtaaagttgcaattaa

SEQ ID NO: 209290 - DNA, 25 bp, E. coli
gaaggacgagtatagttgcaattaa

SEQ ID NO: 209291 - DNA, 25 bp, E. coli
gacgagtaaagttgcaattaaaagg

SEQ ID NO: 209292 - DNA, 25 bp, E. coli
gacgagtaaagtagcaattaaaagg

SEQ ID NO: 209293 - DNA, 25 bp, E. coli
cggaaggacgagaaaagttgcaatt

SEQ ID NO: 209294 - DNA, 25 bp, E. coli
cggaaggacgagtaaagttgcaatt

SEQ ID NO: 209295 - DNA, 25 bp, E. coli
gtaaagttgcaaataaaaggaaatg

SEQ ID NO: 209296 - DNA, 25 bp, E. coli
gtaaagttgcaattaaaaggaaatg

SEQ ID NO: 209297 - DNA, 25 bp, E. coli
tactgaaagcggtaggacgagtaaa

SEQ ID NO: 209298 - DNA, 25 bp, E. coli
tactgaaagcggaaggacgagtaaa

SEQ ID NO: 209299 - DNA, 25 bp, E. coli
caaacttcgtatcgtggaactggca

SEQ ID NO: 209300 - DNA, 25 bp, E. coli
caaacttcgtatggtggaactggca

SEQ ID NO: 209301 - DNA, 25 bp, E. coli
cagaaagaaccgctggcggccattg

SEQ ID NO: 209302 - DNA, 25 bp, E. coli
cagaaagaaccggtggcggccattg

SEQ ID NO: 209303 - DNA, 25 bp, E. coli
catcgccagagcagctcacgctgtt

SEQ ID NO: 209304 - DNA, 25 bp, E. coli
catcgccagagctgctcacgctgtt

SEQ ID NO: 209305 - DNA, 25 bp, E. coli
aggtaacgacctgttctgacactgg

SEQ ID NO: 209306 - DNA, 25 bp, E. coli
aggtaacgacctcttctgacactgg

SEQ ID NO: 209307 - DNA, 25 bp, E. coli
acttccactcagaccagtgtcagtg

SEQ ID NO: 209308 - DNA, 25 bp, E. coli
acttccactcagtccagtgtcagtg

SEQ ID NO: 209309 - DNA, 25 bp, E. coli
tatcacggcgtcatcaggtaacgac

SEQ ID NO: 209310 - DNA, 25 bp, E. coli
tattacctgtagtaataacgccgga

SEQ ID NO: 209311 - DNA, 25 bp, E. coli
tatcacggcgtcttcaggtaacgac

SEQ ID NO: 209312 - DNA, 25 bp, E. coli
tattacctgtagaaataacgccgga

SEQ ID NO: 209313 - DNA, 25 bp, E. coli
gccattgcgccgactttatccactt

SEQ ID NO: 209314 - DNA, 25 bp, E. coli
gccattgcgccgtctttatccactt

SEQ ID NO: 209315 - DNA, 25 bp, E. coli
gaattacaggactggcgaaaagaac

SEQ ID NO: 209316 - DNA, 25 bp, E. coli
gcaaggtggagttccgtcacggtaa

SEQ ID NO: 209317 - DNA, 25 bp, E. coli
gcaaggtggagtaccgtcacggtaa

SEQ ID NO: 209318 - DNA, 25 bp, E. coli
gaattacaggacaggcgaaaagaac

SEQ ID NO: 209319 - DNA, 25 bp, E. coli
tggaactggcatgacaaccaggagc

SEQ ID NO: 209320 - DNA, 25 bp, E. coli
tggaactggcatcacaaccaggagc

SEQ ID NO: 209321 - DNA, 25 bp, E. coli
tacgtcgagcatatgaagaccaacc

SEQ ID NO: 209322 - DNA, 25 bp, E. coli
atgaagaccaaccatcccgacaagc

SEQ ID NO: 209323 - DNA, 25 bp, E. coli
atgaagaccaacgatcccgacaagc

SEQ ID NO: 209324 - DNA, 25 bp, E. coli
tacgtcgagcatttgaagaccaacc

SEQ ID NO: 209325 - DNA, 25 bp, E. coli
tgtttggtaactaaggacaggcaaa

SEQ ID NO: 209326 - DNA, 25 bp, E. coli
tgttgattggcaatccagactacga

SEQ ID NO: 209327 - DNA, 25 bp, E. coli
tgttgattggcattccagactacga

SEQ ID NO: 209328 - DNA, 25 bp, E. coli
tgtttggtaacttaggacaggcaaa

SEQ ID NO: 209329 - DNA, 25 bp, E. coli
tgaagaattcttgcgcgaacgccag

SEQ ID NO: 209330 - DNA, 25 bp, E. coli
tgaagaattcttccgcgaacgccag

SEQ ID NO: 209331 - DNA, 25 bp, E. coli
tcccgacaagccgtacatgagctat

SEQ ID NO: 209332 - DNA, 25 bp, E. coli
tcccgacaagccctacatgagctat

SEQ ID NO: 209333 - DNA, 25 bp, E. coli
gccgtacatgagctatgaagaattc

SEQ ID NO: 209334 - DNA, 25 bp, E. coli
gccgtacatgaggtatgaagaattc

SEQ ID NO: 209335 - DNA, 25 bp, E. coli
gacaactacgtccagcatatgaaga

SEQ ID NO: 209336 - DNA, 25 bp, E. coli
gacaactacgtcgagcatatgaaga

SEQ ID NO: 209337 - DNA, 25 bp, E. coli
ctacggcggcgatggtaaaggcggt

SEQ ID NO: 209338 - DNA, 25 bp, E. coli
ctacggcggcgaaggtaaaggcggt

SEQ ID NO: 209339 - DNA, 25 bp, E. coli
ggcattccagacaacgacaactacg

SEQ ID NO: 209340 - DNA, 25 bp, E. coli
ggcattccagactacgacaactacg

SEQ ID NO: 209341 - DNA, 25 bp, E. coli
gagcatatgaagaccaaccatcccg

SEQ ID NO: 209342 - DNA, 25 bp, E. coli
gagcatatgaagtccaaccatcccg

SEQ ID NO: 209343 - DNA, 25 bp, E. coli
caacggtttccatgacaacggacag

SEQ ID NO: 209344 - DNA, 25 bp, E. coli
caacggtttccaagacaacggacag

SEQ ID NO: 209345 - DNA, 25 bp, E. coli
cagcaatgtgctaccggagtatcgg

SEQ ID NO: 209346 - DNA, 25 bp, E. coli
cagcaatgtgcttccggagtatcgg

SEQ ID NO: 209347 - DNA, 25 bp, E. coli
tacgcttcaggctgatacagagaga

SEQ ID NO: 209348 - DNA, 25 bp, E. coli
tatgggaaagtaatacagctgcagc

SEQ ID NO: 209349 - DNA, 25 bp, E. coli
tatgggaaagtattacagctgcagc

SEQ ID NO: 209350 - DNA, 25 bp, E. coli
tacgcttcaggcagatacagagaga

SEQ ID NO: 209351 - DNA, 25 bp, E. coli
tatacggacagacatatcgacccct

SEQ ID NO: 209352 - DNA, 25 bp, E. coli
tatcagtgcccggtgtgacaacggt

SEQ ID NO: 209353 - DNA, 25 bp, E. coli
tattcccgggagattacgatagact

SEQ ID NO: 209354 - DNA, 25 bp, E. coli
tatcagtgcccgctgtgacaacggt

SEQ ID NO: 209355 - DNA, 25 bp, E. coli
tattcccgggagtttacgatagact

SEQ ID NO: 209356 - DNA, 25 bp, E. coli
tatacggacagagatatcgacccct

SEQ ID NO: 209357 - DNA, 25 bp, E. coli
tgtcagataactcgcgacaggcctg

SEQ ID NO: 209358 - DNA, 25 bp, E. coli
tgtcagataactggcgacaggcctg

SEQ ID NO: 209359 - DNA, 25 bp, E. coli
gacgtggacctctctctgaactggg

SEQ ID NO: 209360 - DNA, 25 bp, E. coli
gacgtggacctcactctgaactggg

SEQ ID NO: 209361 - DNA, 25 bp, E. coli
cgttccggaatgcaaatcagtcgtc

SEQ ID NO: 209362 - DNA, 25 bp, E. coli
cgttccggaatggaaatcagtcgtc

SEQ ID NO: 209363 - DNA, 25 bp, E. coli
tgtgtatacgatcacgccgggagac

SEQ ID NO: 209364 - DNA, 25 bp, E. coli
tgtgtatacgatgacgccgggagac

SEQ ID NO: 209365 - DNA, 25 bp, E. coli
aatcctgggttcaactctgctggca

SEQ ID NO: 209366 - DNA, 25 bp, E. coli
aatcctgggttctactctgctggca

SEQ ID NO: 209367 - DNA, 25 bp, E. coli
cagctcgtgctaaccagcgtctgga

SEQ ID NO: 209368 - DNA, 25 bp, E. coli
cagctcgtgctatccagcgtctgga

SEQ ID NO: 209369 - DNA, 25 bp, E. coli
tactgggcgcggaaatcctgggttc

SEQ ID NO: 209370 - DNA, 25 bp, E. coli
tactgggcgcggtaatcctgggttc

SEQ ID NO: 209371 - DNA, 25 bp, E. coli
tgctaaagatgacgcagctcgtgct

SEQ ID NO: 209372 - DNA, 25 bp, E. coli
tgctaaagatgaggcagctcgtgct

SEQ ID NO: 209373 - DNA, 25 bp, E. coli
tgagcaacgacgtgaacgcaatgcg

SEQ ID NO: 209374 - DNA, 25 bp, E. coli
tgagcaacgacgagaacgcaatgcg

SEQ ID NO: 209375 - DNA, 25 bp, E. coli
tccagcaacgctaaaatcgatcagc

SEQ ID NO: 209376 - DNA, 25 bp, E. coli
tccagcaacgcttaaatcgatcagc

SEQ ID NO: 209377 - DNA, 25 bp, E. coli
gcgtctggacaacatggctactaaa

SEQ ID NO: 209378 - DNA, 25 bp, E. coli
gcgttccgacgtacaggctgctaaa

SEQ ID NO: 209379 - DNA, 25 bp, E. coli
gcgttccgacgttcaggctgctaaa

SEQ ID NO: 209380 - DNA, 25 bp, E. coli
gcgtctggacaagatggctactaaa

SEQ ID NO: 209381 - DNA, 25 bp, E. coli
gaacgctaaagttgaccagctgagc

SEQ ID NO: 209382 - DNA, 25 bp, E. coli
gaacgctaaagtagaccagctgagc

SEQ ID NO: 209383 - DNA, 25 bp, E. coli
gaaagctactaatctggtactgggc

SEQ ID NO: 209384 - DNA, 25 bp, E. coli
gaaagctactaaactggtactgggc

SEQ ID NO: 209385 - DNA, 25 bp, E. coli
gatcagctgtcttctgacgttcaga

SEQ ID NO: 209386 - DNA, 25 bp, E. coli
gatcagctgtctactgacgttcaga

SEQ ID NO: 209387 - DNA, 25 bp, E. coli
aatcagccgccgtggatgtgcaact

SEQ ID NO: 209388 - DNA, 25 bp, E. coli
aatcagccgccgaggatgtgcaact

SEQ ID NO: 209389 - DNA, 25 bp, E. coli
aactggtgtaccagactgacgactc

SEQ ID NO: 209390 - DNA, 25 bp, E. coli
catattaaccggctgcgaaacggcg

SEQ ID NO: 209391 - DNA, 25 bp, E. coli
catattaaccgggtgcgaaacggcg

SEQ ID NO: 209392 - DNA, 25 bp, E. coli
aactggtgtacctgactgacgactc

SEQ ID NO: 209393 - DNA, 25 bp, E. coli
taccaatgcggagggtgaatcagcc

SEQ ID NO: 209394 - DNA, 25 bp, E. coli
taccaatgcggacggtgaatcagcc

SEQ ID NO: 209395 - DNA, 25 bp, E. coli
tgaaccggacaccaataccaatgcg

SEQ ID NO: 209396 - DNA, 25 bp, E. coli
tgaaccggacacgaataccaatgcg

SEQ ID NO: 209397 - DNA, 25 bp, E. coli
tcagcgaggtgaacaaaaacccgga

SEQ ID NO: 209398 - DNA, 25 bp, E. coli
tcagcgaggtgatcaaaaacccgga

SEQ ID NO: 209399 - DNA, 25 bp, E. coli
gaatggaaacaaatcgagacggtgg

SEQ ID NO: 209400 - DNA, 25 bp, E. coli
gaatggaaacaattcgagacggtgg

SEQ ID NO: 209401 - DNA, 25 bp, E. coli
gactcaaaattggaggcagccgact

SEQ ID NO: 209402 - DNA, 25 bp, E. coli
gactcaaaattgcaggcagccgact

SEQ ID NO: 209403 - DNA, 25 bp, E. coli
ccctgccgccgaaaaagctggatga

SEQ ID NO: 209404 - DNA, 25 bp, E. coli
cgcctgctggtgcatgtacgtcaaa

SEQ ID NO: 209405 - DNA, 25 bp, E. coli
cgcctgctggtggatgtacgtcaaa

SEQ ID NO: 209406 - DNA, 25 bp, E. coli
ccctgccgccgataaagctggatga

SEQ ID NO: 209407 - DNA, 25 bp, E. coli
gtcgggagcctgaaggagcaacctt

SEQ ID NO: 209408 - DNA, 25 bp, E. coli
gtcgggagcctgtaggagcaacctt

SEQ ID NO: 209409 - DNA, 25 bp, E. coli
caatctggtgcgctaaaattgtgca

SEQ ID NO: 209410 - DNA, 25 bp, E. coli
caatctggtgcggtaaaattgtgca

SEQ ID NO: 209411 - DNA, 25 bp, E. coli
cagctggagataccagatggatgca

SEQ ID NO: 209412 - DNA, 25 bp, E. coli
cagctggagatagcagatggatgca

SEQ ID NO: 209413 - DNA, 25 bp, E. coli
ctaaataagtgccttgaggtgggct

SEQ ID NO: 209414 - DNA, 25 bp, E. coli
ctaaataagtgcgttgaggtgggct

SEQ ID NO: 209415 - DNA, 25 bp, E. coli
taaagttctgcagcatcagcgatgg

SEQ ID NO: 209416 - DNA, 25 bp, E. coli
taccctgaagatgcaccattctggg

SEQ ID NO: 209417 - DNA, 25 bp, E. coli
taaaattgtgcactcaacacagtga

SEQ ID NO: 209418 - DNA, 25 bp, E. coli
taaaattgtgcagtcaacacagtga

SEQ ID NO: 209419 - DNA, 25 bp, E. coli
taaagttctgcaccatcagcgatgg

SEQ ID NO: 209420 - DNA, 25 bp, E. coli
aacaaaacggcctcctgtcaggaag

SEQ ID NO: 209421 - DNA, 25 bp, E. coli
aacaaaacggccacctgtcaggaag

SEQ ID NO: 209422 - DNA, 25 bp, E. coli
taccctgaagatccaccattctggg

SEQ ID NO: 209423 - DNA, 25 bp, E. coli
tatcgggtactatagttctgcacca

SEQ ID NO: 209424 - DNA, 25 bp, E. coli
tatcgggtactaaagttctgcacca

SEQ ID NO: 209425 - DNA, 25 bp, E. coli
tgcacgatttattgggcaataccct

SEQ ID NO: 209426 - DNA, 25 bp, E. coli
tgcacgatttatagggcaataccct

SEQ ID NO: 209427 - DNA, 25 bp, E. coli
tcaggaagccgcatttatcgggtac

SEQ ID NO: 209428 - DNA, 25 bp, E. coli
tcaggaagccgcttttatcgggtac

SEQ ID NO: 209429 - DNA, 25 bp, E. coli
gaggtgggctgcaaaacaaaacggc

SEQ ID NO: 209430 - DNA, 25 bp, E. coli
gaggtgggctgctaaacaaaacggc

SEQ ID NO: 209431 - DNA, 25 bp, E. coli
aacagcaatgggccaaagataacgg

SEQ ID NO: 209432 - DNA, 25 bp, E. coli
aacagcaatggggcaaagataacgg

SEQ ID NO: 209433 - DNA, 25 bp, E. coli
tttgaacagcaatgggccaaagata

SEQ ID NO: 209434 - DNA, 25 bp, E. coli
ttgaacagcaatcggccaaagataa

SEQ ID NO: 209435 - DNA, 25 bp, E. coli
ttgaacagcaatgggccaaagataa

SEQ ID NO: 209436 - DNA, 25 bp, E. coli
tttgaacagcaaagggccaaagata

SEQ ID NO: 209437 - DNA, 25 bp, E. coli
tgaacagcaatgggccaaagataac

SEQ ID NO: 209438 - DNA, 25 bp, E. coli
tgaacagcaatgcgccaaagataac

SEQ ID NO: 209439 - DNA, 25 bp, E. coli
gccgtttgaacaccaatgggccaaa

SEQ ID NO: 209440 - DNA, 25 bp, E. coli
gccgtttgaacagcaatgggccaaa

SEQ ID NO: 209441 - DNA, 25 bp, E. coli
gaacagcaatggcccaaagataacg

SEQ ID NO: 209442 - DNA, 25 bp, E. coli
gaacagcaatgggccaaagataacg

SEQ ID NO: 209443 - DNA, 25 bp, E. coli
ccgtttgaacagcaatgggccaaag

SEQ ID NO: 209444 - DNA, 25 bp, E. coli
ccgccgtttgaagagcaatgggcca

SEQ ID NO: 209445 - DNA, 25 bp, E. coli
ccgccgtttgaacagcaatgggcca

SEQ ID NO: 209446 - DNA, 25 bp, E. coli
ccgtttgaacaggaatgggccaaag

SEQ ID NO: 209447 - DNA, 25 bp, E. coli
cgtttgaacagctatgggccaaaga

SEQ ID NO: 209448 - DNA, 25 bp, E. coli
cgtttgaacagcaatgggccaaaga

SEQ ID NO: 209449 - DNA, 25 bp, E. coli
cgccgtttgaactgcaatgggccaa

SEQ ID NO: 209450 - DNA, 25 bp, E. coli
cgccgtttgaacagcaatgggccaa

SEQ ID NO: 209451 - DNA, 25 bp, E. coli
gtttgaacagcattgggccaaagat

SEQ ID NO: 209452 - DNA, 25 bp, E. coli
gtttgaacagcaatgggccaaagat

SEQ ID NO: 209453 - DNA, 25 bp, E. coli
tacaaagtgcaggtgatgacaccgg

SEQ ID NO: 209454 - DNA, 25 bp, E. coli
tacaaagtgcagctgatgacaccgg

SEQ ID NO: 209455 - DNA, 25 bp, E. coli
tagcgtgctgcaggcgaaaaactac

SEQ ID NO: 209456 - DNA, 25 bp, E. coli
tatgcaatcccggtgaccaacggta

SEQ ID NO: 209457 - DNA, 25 bp, E. coli
tatgcaatcccgctgaccaacggta

SEQ ID NO: 209458 - DNA, 25 bp, E. coli
tagcgtgctgcacgcgaaaaactac

SEQ ID NO: 209459 - DNA, 25 bp, E. coli
tatcagcaggcggttacggttaaac

SEQ ID NO: 209460 - DNA, 25 bp, E. coli
tatcagcaggcgcttacggttaaac

SEQ ID NO: 209461 - DNA, 25 bp, E. coli
ttaccaatgctgctcgtacgcgggc

SEQ ID NO: 209462 - DNA, 25 bp, E. coli
ttaccaatgctggtcgtacgcgggc

SEQ ID NO: 209463 - DNA, 25 bp, E. coli
tgactcagagtcagaacgacgcgct

SEQ ID NO: 209464 - DNA, 25 bp, E. coli
tgatgaagcctacctggaagcggca

SEQ ID NO: 209465 - DNA, 25 bp, E. coli
tgactcagagtctgaacgacgcgct

SEQ ID NO: 209466 - DNA, 25 bp, E. coli
tgatgaagcctagctggaagcggca

SEQ ID NO: 209467 - DNA, 25 bp, E. coli
tccatgcagcgttacagcacggaga

SEQ ID NO: 209468 - DNA, 25 bp, E. coli
tccatgcagcgtaacagcacggaga

SEQ ID NO: 209469 - DNA, 25 bp, E. coli
ccaacgtgatgaagctggtcagaca

SEQ ID NO: 209470 - DNA, 25 bp, E. coli
ccaacgtgatgatgctggtcagaca

SEQ ID NO: 209471 - DNA, 25 bp, E. coli
gtcagacactgaccaccgattgggt

SEQ ID NO: 209472 - DNA, 25 bp, E. coli
gtcagacactgagcaccgattgggt

SEQ ID NO: 209473 - DNA, 25 bp, E. coli
tcaaatctctgttaagccgcagggt

SEQ ID NO: 209474 - DNA, 25 bp, E. coli
tcaaatctctgtaaagccgcagggt

SEQ ID NO: 209475 - DNA, 25 bp, E. coli
caaaggattgttcctcaaaagcggc

SEQ ID NO: 209476 - DNA, 25 bp, E. coli
caaaggattgttgctcaaaagcggc

SEQ ID NO: 209477 - DNA, 25 bp, E. coli
aaatcacctcaatggattgttgctc

SEQ ID NO: 209478 - DNA, 25 bp, E. coli
aaatcacctcaaaggattgttgctc

SEQ ID NO: 209479 - DNA, 25 bp, E. coli
taccacgcagcttcggtcgatcctc

SEQ ID NO: 209480 - DNA, 25 bp, E. coli
taccacgcagctacggtcgatcctc

SEQ ID NO: 209481 - DNA, 25 bp, E. coli
tatctgaacattcccgcagaggcaa

SEQ ID NO: 209482 - DNA, 25 bp, E. coli
tatctgaacattgccgcagaggcaa

SEQ ID NO: 209483 - DNA, 25 bp, E. coli
ttgttgctcaaatgcggcggcacca

SEQ ID NO: 209484 - DNA, 25 bp, E. coli
ttatctgaacattcccgcagaggca

SEQ ID NO: 209485 - DNA, 25 bp, E. coli
ttatctgaacatacccgcagaggca

SEQ ID NO: 209486 - DNA, 25 bp, E. coli
ttgttgctcaaaagcggcggcacca

SEQ ID NO: 209487 - DNA, 25 bp, E. coli
tgttgctcaaaaccggcggcaccac

SEQ ID NO: 209488 - DNA, 25 bp, E. coli
tgttgctcaaaagcggcggcaccac

SEQ ID NO: 209489 - DNA, 25 bp, E. coli
tcacctcaaaggtttgttgctcaaa

SEQ ID NO: 209490 - DNA, 25 bp, E. coli
tcacctcaaaggattgttgctcaaa

SEQ ID NO: 209491 - DNA, 25 bp, E. coli
cctcaaaggattcttgctcaaaagc

SEQ ID NO: 209492 - DNA, 25 bp, E. coli
cctcaaaggattgttgctcaaaagc

SEQ ID NO: 209493 - DNA, 25 bp, E. coli
gaacattcccgcagaggcaaacccg

SEQ ID NO: 209494 - DNA, 25 bp, E. coli
gaacattcccgctgaggcaaacccg

SEQ ID NO: 209495 - DNA, 25 bp, E. coli
gattgttgctcaaaagcggcggcac

SEQ ID NO: 209496 - DNA, 25 bp, E. coli
gattgttgctcataagcggcggcac

SEQ ID NO: 209497 - DNA, 25 bp, E. coli
agttcgccgcggttccggcgctgtt

SEQ ID NO: 209498 - DNA, 25 bp, E. coli
atgctgattgcccagttcgccgcgg

SEQ ID NO: 209499 - DNA, 25 bp, E. coli
gttcccaatttatcaagcctttgct

SEQ ID NO: 209500 - DNA, 25 bp, E. coli
atgctgattgccgagttcgccgcgg

SEQ ID NO: 209501 - DNA, 25 bp, E. coli
gttcccaatttaacaagcctttgct

SEQ ID NO: 209502 - DNA, 25 bp, E. coli
agttcgccgcggatccggcgctgtt

SEQ ID NO: 209503 - DNA, 25 bp, E. coli
tagcgatgttccgaatttaacaagc

SEQ ID NO: 209504 - DNA, 25 bp, E. coli
tagcgatgttcccaatttaacaagc

SEQ ID NO: 209505 - DNA, 25 bp, E. coli
tatttactgcacttggctgcgtggc

SEQ ID NO: 209506 - DNA, 25 bp, E. coli
tatttactgcacatggctgcgtggc

SEQ ID NO: 209507 - DNA, 25 bp, E. coli
tccggtatggaatacgggtctgcgt

SEQ ID NO: 209508 - DNA, 25 bp, E. coli
tccggtatggaaaacgggtctgcgt

SEQ ID NO: 209509 - DNA, 25 bp, E. coli
ctggcgcagggcaatctcggacgcc

SEQ ID NO: 209510 - DNA, 25 bp, E. coli
cgggtgatctctatctcactggcat

SEQ ID NO: 209511 - DNA, 25 bp, E. coli
cgggtgatctctttctcactggcat

SEQ ID NO: 209512 - DNA, 25 bp, E. coli
ctggcgcagggctatctcggacgcc

SEQ ID NO: 209513 - DNA, 25 bp, E. coli
cggctatcgtcaaccgcctgctttg

SEQ ID NO: 209514 - DNA, 25 bp, E. coli
cggctatcgtcatccgcctgctttg

SEQ ID NO: 209515 - DNA, 25 bp, E. coli
gatcgccaatatatactgcacatgg

SEQ ID NO: 209516 - DNA, 25 bp, E. coli
gatcgccaatatttactgcacatgg

SEQ ID NO: 209517 - DNA, 25 bp, E. coli
ggctatctcggaggccccgatctga

SEQ ID NO: 209518 - DNA, 25 bp, E. coli
ggctatctcggacgccccgatctga

SEQ ID NO: 209519 - DNA, 25 bp, E. coli
cagaaggtttatttagttagaagca

SEQ ID NO: 209520 - DNA, 25 bp, E. coli
cagaaggtttatatagttagaagca

SEQ ID NO: 209521 - DNA, 25 bp, E. coli
tacaccgagtgcattagggaaggtg

SEQ ID NO: 209522 - DNA, 25 bp, E. coli
taaagggtaatatataacagaaggt

SEQ ID NO: 209523 - DNA, 25 bp, E. coli
taaagggtaataaataacagaaggt

SEQ ID NO: 209524 - DNA, 25 bp, E. coli
tacaccgagtgctttagggaaggtg

SEQ ID NO: 209525 - DNA, 25 bp, E. coli
tatatagttagatgcaaggttgtgc

SEQ ID NO: 209526 - DNA, 25 bp, E. coli
tatatagttagaagcaaggttgtgc

SEQ ID NO: 209527 - DNA, 25 bp, E. coli
gcttgagggagcgacttatatgttg

SEQ ID NO: 209528 - DNA, 25 bp, E. coli
gcttgagggagccacttatatgttg

SEQ ID NO: 209529 - DNA, 25 bp, E. coli
gcaaggttgtgcttctaaaggaagt

SEQ ID NO: 209530 - DNA, 25 bp, E. coli
gcaacatatctttttcgtaatcaga

SEQ ID NO: 209531 - DNA, 25 bp, E. coli
gcaaggttgtgcatctaaaggaagt

SEQ ID NO: 209532 - DNA, 25 bp, E. coli
gcaacatatcttattcgtaatcaga

SEQ ID NO: 209533 - DNA, 25 bp, E. coli
cttctaaaggaactggcttgaggga

SEQ ID NO: 209534 - DNA, 25 bp, E. coli
cttctaaaggaagtggcttgaggga

SEQ ID NO: 209535 - DNA, 25 bp, E. coli
ggaggcaacgcctcccgcaacatat

SEQ ID NO: 209536 - DNA, 25 bp, E. coli
ggaggcaacgccacccgcaacatat

SEQ ID NO: 209537 - DNA, 25 bp, E. coli
gatgtcatcagtgcttacaccgagt

SEQ ID NO: 209538 - DNA, 25 bp, E. coli
gacctacagcaaggatgtcatcagt

SEQ ID NO: 209539 - DNA, 25 bp, E. coli
gatgtcatcagtccttacaccgagt

SEQ ID NO: 209540 - DNA, 25 bp, E. coli
gacctacagcaacgatgtcatcagt

SEQ ID NO: 209541 - DNA, 25 bp, E. coli
aatacgccttgtgtattcctgacgg

SEQ ID NO: 209542 - DNA, 25 bp, E. coli
aatacgccttgtctattcctgacgg

SEQ ID NO: 209543 - DNA, 25 bp, E. coli
catgatttcgatttacattgccacc

SEQ ID NO: 209544 - DNA, 25 bp, E. coli
catgatttcgatatacattgccacc

SEQ ID NO: 209545 - DNA, 25 bp, E. coli
taaagcggcatgttacaaagtgaac

SEQ ID NO: 209546 - DNA, 25 bp, E. coli
tacattgccaccataccgcttcaga

SEQ ID NO: 209547 - DNA, 25 bp, E. coli
taaagcggcatgatacaaagtgaac

SEQ ID NO: 209548 - DNA, 25 bp, E. coli
tacattactttgttataagacgtga

SEQ ID NO: 209549 - DNA, 25 bp, E. coli
tacattgccaccttaccgcttcaga

SEQ ID NO: 209550 - DNA, 25 bp, E. coli
tacattactttgatataagacgtga

SEQ ID NO: 209551 - DNA, 25 bp, E. coli
tgatacaaagtgaacatgatttcga

SEQ ID NO: 209552 - DNA, 25 bp, E. coli
tgatacaaagtgtacatgatttcga

SEQ ID NO: 209553 - DNA, 25 bp, E. coli
tcctgacggcaataataaggaatat

SEQ ID NO: 209554 - DNA, 25 bp, E. coli
tcctgacggcaaaaataaggaatat

SEQ ID NO: 209555 - DNA, 25 bp, E. coli
ccttttcatttaataaagcggcatg

SEQ ID NO: 209556 - DNA, 25 bp, E. coli
ccttttcatttattaaagcggcatg

SEQ ID NO: 209557 - DNA, 25 bp, E. coli
cgcttcagacaagcggtacattact

SEQ ID NO: 209558 - DNA, 25 bp, E. coli
cgcttcagacaaccggtacattact

SEQ ID NO: 209559 - DNA, 25 bp, E. coli
gatatataattcaaaacaacgtggt

SEQ ID NO: 209560 - DNA, 25 bp, E. coli
gatatataattctaaacaacgtggt

SEQ ID NO: 209561 - DNA, 25 bp, E. coli
gattgctttggtttcttacaacaca

SEQ ID NO: 209562 - DNA, 25 bp, E. coli
gattgctttggtatcttacaacaca

SEQ ID NO: 209563 - DNA, 25 bp, E. coli
caatcaggaaagataaaaacgggcg

SEQ ID NO: 209564 - DNA, 25 bp, E. coli
caatcaggaaagttaaaaacgggcg

SEQ ID NO: 209565 - DNA, 25 bp, E. coli
cataaatactatagacgggacggga

SEQ ID NO: 209566 - DNA, 25 bp, E. coli
cataaatactattgacgggacggga

SEQ ID NO: 209567 - DNA, 25 bp, E. coli
tactatagacgggacgggatgaaag

SEQ ID NO: 209568 - DNA, 25 bp, E. coli
tactatagacggcacgggatgaaag

SEQ ID NO: 209569 - DNA, 25 bp, E. coli
tatgattattaaaagcaaaccctca

SEQ ID NO: 209570 - DNA, 25 bp, E. coli
tatgattattaatagcaaaccctca

SEQ ID NO: 209571 - DNA, 25 bp, E. coli
tgaactcaaagcgataacggcccac

SEQ ID NO: 209572 - DNA, 25 bp, E. coli
tgaactcaaagccataacggcccac

SEQ ID NO: 209573 - DNA, 25 bp, E. coli
tgcgcataaaataaggatgatcaga

SEQ ID NO: 209574 - DNA, 25 bp, E. coli
tgcgcataaaattaggatgatcaga

SEQ ID NO: 209575 - DNA, 25 bp, E. coli
cgggatgaaagtcggagtaaaatca

SEQ ID NO: 209576 - DNA, 25 bp, E. coli
cgggatgaaagtgggagtaaaatca

SEQ ID NO: 209577 - DNA, 25 bp, E. coli
gtaatcagtgcgcataaaataagga

SEQ ID NO: 209578 - DNA, 25 bp, E. coli
ggatgatcagaaagaactcaaagcg

SEQ ID NO: 209579 - DNA, 25 bp, E. coli
gtaaaatcagataactacaatcagg

SEQ ID NO: 209580 - DNA, 25 bp, E. coli
ggatgatcagaatgaactcaaagcg

SEQ ID NO: 209581 - DNA, 25 bp, E. coli
gtaaaatcagattactacaatcagg

SEQ ID NO: 209582 - DNA, 25 bp, E. coli
gtaatcagtgcggataaaataagga

SEQ ID NO: 209583 - DNA, 25 bp, E. coli
tcacactctggtcggtaattatgat

SEQ ID NO: 209584 - DNA, 25 bp, E. coli
tcacactctggtgggtaattatgat

SEQ ID NO: 209585 - DNA, 25 bp, E. coli
acatggctgaatgcggtgatcccgc

SEQ ID NO: 209586 - DNA, 25 bp, E. coli
acatggctgaatccggtgatcccgc

SEQ ID NO: 209587 - DNA, 25 bp, E. coli
tgacgaagcagatgaaatggaagcc

SEQ ID NO: 209588 - DNA, 25 bp, E. coli
tgctctgggctatgaggatccgtac

SEQ ID NO: 209589 - DNA, 25 bp, E. coli
tgacgaagcagaagaaatggaagcc

SEQ ID NO: 209590 - DNA, 25 bp, E. coli
tgctctgggctaagaggatccgtac

SEQ ID NO: 209591 - DNA, 25 bp, E. coli
ttcgcgtggtcgataccgccgaaag

SEQ ID NO: 209592 - DNA, 25 bp, E. coli
tcaggagcaagggaaaccactggag

SEQ ID NO: 209593 - DNA, 25 bp, E. coli
ttcgcgtggtcgttaccgccgaaag

SEQ ID NO: 209594 - DNA, 25 bp, E. coli
tcaggagcaaggcaaaccactggag

SEQ ID NO: 209595 - DNA, 25 bp, E. coli
gctactgggcgatctggttatctgc

SEQ ID NO: 209596 - DNA, 25 bp, E. coli
gctactgggcgaactggttatctgc

SEQ ID NO: 209597 - DNA, 25 bp, E. coli
cgcatatggtggagcacggcagtct

SEQ ID NO: 209598 - DNA, 25 bp, E. coli
cgcatatggtggtgcacggcagtct

SEQ ID NO: 209599 - DNA, 25 bp, E. coli
cggtgatcccgcagtttcaggaaga

SEQ ID NO: 209600 - DNA, 25 bp, E. coli
cggtgatcccgctgtttcaggaaga

SEQ ID NO: 209601 - DNA, 25 bp, E. coli
ggtgatcctcgaattacaactggca

SEQ ID NO: 209602 - DNA, 25 bp, E. coli
ggatccgtacattgccgagaaagaa

SEQ ID NO: 209603 - DNA, 25 bp, E. coli
ggtgatcctcgatttacaactggca

SEQ ID NO: 209604 - DNA, 25 bp, E. coli
ggatccgtacatagccgagaaagaa

SEQ ID NO: 209605 - DNA, 25 bp, E. coli
taaggataagccgaccaacgtgctc

SEQ ID NO: 209606 - DNA, 25 bp, E. coli
taaggataagcccaccaacgtgctc

SEQ ID NO: 209607 - DNA, 25 bp, E. coli
cagaagcagaaatagcttattatgc

SEQ ID NO: 209608 - DNA, 25 bp, E. coli
cagaagcagaaaaagcttattatgc

SEQ ID NO: 209609 - DNA, 25 bp, E. coli
cagaaaaagctttttatgcttccat

SEQ ID NO: 209610 - DNA, 25 bp, E. coli
cagaaaaagcttattatgcttccat

SEQ ID NO: 209611 - DNA, 25 bp, E. coli
agaagcagaaaatgcttattatgct

SEQ ID NO: 209612 - DNA, 25 bp, E. coli
agaagcagaaaaagcttattatgct

SEQ ID NO: 209613 - DNA, 25 bp, E. coli
agaaaaagcttaatatgcttccatc

SEQ ID NO: 209614 - DNA, 25 bp, E. coli
agaaaaagcttattatgcttccatc

SEQ ID NO: 209615 - DNA, 25 bp, E. coli
agcagaaaaagcttattatgcttcc

SEQ ID NO: 209616 - DNA, 25 bp, E. coli
agcagaaaaagcatattatgcttcc

SEQ ID NO: 209617 - DNA, 25 bp, E. coli
tccggcagaagcagaaaaagcttat

SEQ ID NO: 209618 - DNA, 25 bp, E. coli
tccggcagaagctgaaaaagcttat

SEQ ID NO: 209619 - DNA, 25 bp, E. coli
cctccggcagaaccagaaaaagctt

SEQ ID NO: 209620 - DNA, 25 bp, E. coli
cctccggcagaagcagaaaaagctt

SEQ ID NO: 209621 - DNA, 25 bp, E. coli
gcagaagcagaaaaagcttattatg

SEQ ID NO: 209622 - DNA, 25 bp, E. coli
gcagaaaaagctaattatgcttcca

SEQ ID NO: 209623 - DNA, 25 bp, E. coli
gcagaaaaagcttattatgcttcca

SEQ ID NO: 209624 - DNA, 25 bp, E. coli
gcagaagcagaataagcttattatg

SEQ ID NO: 209625 - DNA, 25 bp, E. coli
ctccggcagaaggagaaaaagctta

SEQ ID NO: 209626 - DNA, 25 bp, E. coli
ctccggcagaagcagaaaaagctta

SEQ ID NO: 209627 - DNA, 25 bp, E. coli
ggcagaagcagataaagcttattat

SEQ ID NO: 209628 - DNA, 25 bp, E. coli
ggcagaagcagaaaaagcttattat

SEQ ID NO: 209629 - DNA, 25 bp, E. coli
cactcaaaagttagaaatcccggca

SEQ ID NO: 209630 - DNA, 25 bp, E. coli
cactcaaaagtttgaaatcccggca

SEQ ID NO: 209631 - DNA, 25 bp, E. coli
acatggtgcaggctatatcgcagac

SEQ ID NO: 209632 - DNA, 25 bp, E. coli
acatggtgcagggtatatcgcagac

SEQ ID NO: 209633 - DNA, 25 bp, E. coli
tagaaatcccggcaaaggaggcagc

SEQ ID NO: 209634 - DNA, 25 bp, E. coli
tatcgcagacgaggttaatgatctg

SEQ ID NO: 209635 - DNA, 25 bp, E. coli
tatcgcagacgacgttaatgatctg

SEQ ID NO: 209636 - DNA, 25 bp, E. coli
tagaaatcccgggaaaggaggcagc

SEQ ID NO: 209637 - DNA, 25 bp, E. coli
tcccgcattgaaatgtatggacatg

SEQ ID NO: 209638 - DNA, 25 bp, E. coli
tcccgcattgaattgtatggacatg

SEQ ID NO: 209639 - DNA, 25 bp, E. coli
gaagatcctgatcgtgattatgtcc

SEQ ID NO: 209640 - DNA, 25 bp, E. coli
gaagatcctgatggtgattatgtcc

SEQ ID NO: 209641 - DNA, 25 bp, E. coli
gaatttatcaaaaatcgcgaacctg

SEQ ID NO: 209642 - DNA, 25 bp, E. coli
gaatttatcaaatatcgcgaacctg

SEQ ID NO: 209643 - DNA, 25 bp, E. coli
cgaacctgaagcgatacgagcttga

SEQ ID NO: 209644 - DNA, 25 bp, E. coli
cgaacctgaagccatacgagcttga

SEQ ID NO: 209645 - DNA, 25 bp, E. coli
cttgatatgggacgttgcgactcgt

SEQ ID NO: 209646 - DNA, 25 bp, E. coli
cttgatatgggaggttgcgactcgt

SEQ ID NO: 209647 - DNA, 25 bp, E. coli
gattgtggcgctgatatgactgaag

SEQ ID NO: 209648 - DNA, 25 bp, E. coli
gattgtggcgctcatatgactgaag

SEQ ID NO: 209649 - DNA, 25 bp, E. coli
taatgatctggcaatactggcgctg

SEQ ID NO: 209650 - DNA, 25 bp, E. coli
taatgatctggctatactggcgctg

SEQ ID NO: 209651 - DNA, 25 bp, E. coli
aatgacaggcgtaactggcgtgccg

SEQ ID NO: 209652 - DNA, 25 bp, E. coli
aatgacaggcgttactggcgtgccg

SEQ ID NO: 209653 - DNA, 25 bp, E. coli
agtgtttgggcccttattgcgcgtc

SEQ ID NO: 209654 - DNA, 25 bp, E. coli
agtgtttgggccgttattgcgcgtc

SEQ ID NO: 209655 - DNA, 25 bp, E. coli
tatgccgcagataattgtgcctggc

SEQ ID NO: 209656 - DNA, 25 bp, E. coli
tatgccgcagattattgtgcctggc

SEQ ID NO: 209657 - DNA, 25 bp, E. coli
tttctgaaaagtggaacgcagggcg

SEQ ID NO: 209658 - DNA, 25 bp, E. coli
tttctgaaaagtcgaacgcagggcg

SEQ ID NO: 209659 - DNA, 25 bp, E. coli
ttgtgcctggcccatggcaagtctg

SEQ ID NO: 209660 - DNA, 25 bp, E. coli
ttgtgcctggccgatggcaagtctg

SEQ ID NO: 209661 - DNA, 25 bp, E. coli
tctcatttggcgttcgtcaggtaag

SEQ ID NO: 209662 - DNA, 25 bp, E. coli
tctcatttggcgatcgtcaggtaag

SEQ ID NO: 209663 - DNA, 25 bp, E. coli
gctgggctcggctctcatttggcga

SEQ ID NO: 209664 - DNA, 25 bp, E. coli
gctgggctcggcactcatttggcga

SEQ ID NO: 209665 - DNA, 25 bp, E. coli
gatcgtcaggtatgagttgaacgct

SEQ ID NO: 209666 - DNA, 25 bp, E. coli
gatcgtcaggtaagagttgaacgct

SEQ ID NO: 209667 - DNA, 25 bp, E. coli
cgttactggcgtcccggatgaagaa

SEQ ID NO: 209668 - DNA, 25 bp, E. coli
cgttactggcgtgccggatgaagaa

SEQ ID NO: 209669 - DNA, 25 bp, E. coli
gagttgaacgctttgctggattgct

SEQ ID NO: 209670 - DNA, 25 bp, E. coli
gagttgaacgctatgctggattgct

SEQ ID NO: 209671 - DNA, 25 bp, E. coli
gatgaagaagtgattgggccgttat

SEQ ID NO: 209672 - DNA, 25 bp, E. coli
gatgaagaagtgtttgggccgttat

SEQ ID NO: 209673 - DNA, 25 bp, E. coli
caattaccgtgaaattgagctacat

SEQ ID NO: 209674 - DNA, 25 bp, E. coli
aatgcctcaaaattttgccaaatgc

SEQ ID NO: 209675 - DNA, 25 bp, E. coli
aatgcctcaaaaatttgccaaatgc

SEQ ID NO: 209676 - DNA, 25 bp, E. coli
aagcgcaaccagtcaattaccgtga

SEQ ID NO: 209677 - DNA, 25 bp, E. coli
caattaccgtgatattgagctacat

SEQ ID NO: 209678 - DNA, 25 bp, E. coli
aagcgcaaccagacaattaccgtga

SEQ ID NO: 209679 - DNA, 25 bp, E. coli
tacgatgtcggcaaaatgcctcaaa

SEQ ID NO: 209680 - DNA, 25 bp, E. coli
tacgatgtcggctaaatgcctcaaa

SEQ ID NO: 209681 - DNA, 25 bp, E. coli
tattaaaaatccaacgatgtcggca

SEQ ID NO: 209682 - DNA, 25 bp, E. coli
tattaaaaatcctacgatgtcggca

SEQ ID NO: 209683 - DNA, 25 bp, E. coli
tccacctatagagaagcgcaaccag

SEQ ID NO: 209684 - DNA, 25 bp, E. coli
tccacctatagacaagcgcaaccag

SEQ ID NO: 209685 - DNA, 25 bp, E. coli
tccttaaaatttggctccaaatggc

SEQ ID NO: 209686 - DNA, 25 bp, E. coli
tccttaaaatttcgctccaaatggc

SEQ ID NO: 209687 - DNA, 25 bp, E. coli
tgccaaatgcaatgcctaaataaga

SEQ ID NO: 209688 - DNA, 25 bp, E. coli
tgccaaatgcaaagcctaaataaga

SEQ ID NO: 209689 - DNA, 25 bp, E. coli
gctccaaatggcaaaatatacacaa

SEQ ID NO: 209690 - DNA, 25 bp, E. coli
gctccaaatggctaaatatacacaa

SEQ ID NO: 209691 - DNA, 25 bp, E. coli
gcgataattcgctgttggtgtaata

SEQ ID NO: 209692 - DNA, 25 bp, E. coli
gcgataattcgcagttggtgtaata

SEQ ID NO: 209693 - DNA, 25 bp, E. coli
gagctacatttctggcgataattcg

SEQ ID NO: 209694 - DNA, 25 bp, E. coli
gagctacatttcaggcgataattcg

SEQ ID NO: 209695 - DNA, 25 bp, E. coli
cagcgtatttccaggctagccgccg

SEQ ID NO: 209696 - DNA, 25 bp, E. coli
cagcgtatttcctggctagccgccg

SEQ ID NO: 209697 - DNA, 25 bp, E. coli
tatggttgtccaccagagttgctga

SEQ ID NO: 209698 - DNA, 25 bp, E. coli
tatggttgtccagcagagttgctga

SEQ ID NO: 209699 - DNA, 25 bp, E. coli
tatcaatttaatgttcagccagcgt

SEQ ID NO: 209700 - DNA, 25 bp, E. coli
tatcaatttaatcttcagccagcgt

SEQ ID NO: 209701 - DNA, 25 bp, E. coli
tcgaaaagacggaacggcttagctc

SEQ ID NO: 209702 - DNA, 25 bp, E. coli
tcgaaaagacggtacggcttagctc

SEQ ID NO: 209703 - DNA, 25 bp, E. coli
tctggaaaaccacgaacgggagatt

SEQ ID NO: 209704 - DNA, 25 bp, E. coli
tctctaaaacagttcgaaaagacgg

SEQ ID NO: 209705 - DNA, 25 bp, E. coli
tctctaaaacagatcgaaaagacgg

SEQ ID NO: 209706 - DNA, 25 bp, E. coli
tctggaaaaccaggaacgggagatt

SEQ ID NO: 209707 - DNA, 25 bp, E. coli
gccgccgtgcgtttcaggcataaat

SEQ ID NO: 209708 - DNA, 25 bp, E. coli
ccttcctggatgtcggctgaacata

SEQ ID NO: 209709 - DNA, 25 bp, E. coli
gccgccgtgcgtatcaggcataaat

SEQ ID NO: 209710 - DNA, 25 bp, E. coli
ccttcctggatgacggctgaacata

SEQ ID NO: 209711 - DNA, 25 bp, E. coli
gaacggcttagctcaaacatcaaaa

SEQ ID NO: 209712 - DNA, 25 bp, E. coli
gaacggcttagcacaaacatcaaaa

SEQ ID NO: 209713 - DNA, 25 bp, E. coli
ggcataaattatggcttgctgaagt

SEQ ID NO: 209714 - DNA, 25 bp, E. coli
ggcataaattatcgcttgctgaagt

SEQ ID NO: 209715 - DNA, 25 bp, E. coli
gagttgctgataagcccttcctgga

SEQ ID NO: 209716 - DNA, 25 bp, E. coli
gagttgctgatatgcccttcctgga

SEQ ID NO: 209717 - DNA, 25 bp, E. coli
caacttccggcaaaaaagtgataca

SEQ ID NO: 209718 - DNA, 25 bp, E. coli
caataatctgggataattttcatga

SEQ ID NO: 209719 - DNA, 25 bp, E. coli
caacttccggcataaaagtgataca

SEQ ID NO: 209720 - DNA, 25 bp, E. coli
caagatcgatgagatagcgttgaag

SEQ ID NO: 209721 - DNA, 25 bp, E. coli
caagatcgatgacatagcgttgaag

SEQ ID NO: 209722 - DNA, 25 bp, E. coli
caataatctgggttaattttcatga

SEQ ID NO: 209723 - DNA, 25 bp, E. coli
tattgctgccaaaaatctgggataa

SEQ ID NO: 209724 - DNA, 25 bp, E. coli
tattgctgccaataatctgggataa

SEQ ID NO: 209725 - DNA, 25 bp, E. coli
tgatacaagatccatgacatagcgt

SEQ ID NO: 209726 - DNA, 25 bp, E. coli
tgatacaagatcgatgacatagcgt

SEQ ID NO: 209727 - DNA, 25 bp, E. coli
ccaactaataaaatgcaaacaactt

SEQ ID NO: 209728 - DNA, 25 bp, E. coli
cctatccaactattaaaatgcaaac

SEQ ID NO: 209729 - DNA, 25 bp, E. coli
ccaactaataaattgcaaacaactt

SEQ ID NO: 209730 - DNA, 25 bp, E. coli
cctatccaactaataaaatgcaaac

SEQ ID NO: 209731 - DNA, 25 bp, E. coli
gctgccaataatgtgggataatttt

SEQ ID NO: 209732 - DNA, 25 bp, E. coli
gctgccaataatctgggataatttt

SEQ ID NO: 209733 - DNA, 25 bp, E. coli
ccggcaaaaaagtgatacaagatcg

SEQ ID NO: 209734 - DNA, 25 bp, E. coli
ccggcaaaaaagagatacaagatcg

SEQ ID NO: 209735 - DNA, 25 bp, E. coli
gatcgatgacatagcgttgaagaaa

SEQ ID NO: 209736 - DNA, 25 bp, E. coli
gatcgatgacattgcgttgaagaaa

SEQ ID NO: 209737 - DNA, 25 bp, E. coli
gatgacatagcgatgaagaaaagga

SEQ ID NO: 209738 - DNA, 25 bp, E. coli
gatgacatagcgttgaagaaaagga

SEQ ID NO: 209739 - DNA, 25 bp, E. coli
cagtattcagactagtaagtgcgct

SEQ ID NO: 209740 - DNA, 25 bp, E. coli
cagtattcagacaagtaagtgcgct

SEQ ID NO: 209741 - DNA, 25 bp, E. coli
taccattatgacgtggcagcctacg

SEQ ID NO: 209742 - DNA, 25 bp, E. coli
taccattatgacctggcagcctacg

SEQ ID NO: 209743 - DNA, 25 bp, E. coli
aaagcacccgtaatactggctggga

SEQ ID NO: 209744 - DNA, 25 bp, E. coli
aaagcacccgtattactggctggga

SEQ ID NO: 209745 - DNA, 25 bp, E. coli
ttcaatgctgattgccgccgtgcgc

SEQ ID NO: 209746 - DNA, 25 bp, E. coli
ttagcagtccgcaggtcaacaacgg

SEQ ID NO: 209747 - DNA, 25 bp, E. coli
ttagcagtccgctggtcaacaacgg

SEQ ID NO: 209748 - DNA, 25 bp, E. coli
ttcaatgctgatagccgccgtgcgc

SEQ ID NO: 209749 - DNA, 25 bp, E. coli
tgaggtcgtcgctcgtcatgaaagt

SEQ ID NO: 209750 - DNA, 25 bp, E. coli
tgaggtcgtcgcacgtcatgaaagt

SEQ ID NO: 209751 - DNA, 25 bp, E. coli
tgtccgatcaaaaactgtcagtggc

SEQ ID NO: 209752 - DNA, 25 bp, E. coli
tgtccgatcaaatactgtcagtggc

SEQ ID NO: 209753 - DNA, 25 bp, E. coli
gcgttaacccaatgtgcagtattca

SEQ ID NO: 209754 - DNA, 25 bp, E. coli
gcgttaacccaaagtgcagtattca

SEQ ID NO: 209755 - DNA, 25 bp, E. coli
gaagagaagtctcactcaccgcact

SEQ ID NO: 209756 - DNA, 25 bp, E. coli
gaagagaagtctgactcaccgcact

SEQ ID NO: 209757 - DNA, 25 bp, E. coli
ccctgggcggaactagaatatctct

SEQ ID NO: 209758 - DNA, 25 bp, E. coli
ccctgggcggaagtagaatatctct

SEQ ID NO: 209759 - DNA, 25 bp, E. coli
taatctcggcgtcgcgctgttacca

SEQ ID NO: 209760 - DNA, 25 bp, E. coli
taatctcggcgtggcgctgttacca

SEQ ID NO: 209761 - DNA, 25 bp, E. coli
caaccgggcagtcatgtgattgtct

SEQ ID NO: 209762 - DNA, 25 bp, E. coli
caaccgggcagtgatgtgattgtct

SEQ ID NO: 209763 - DNA, 25 bp, E. coli
cacactggagcgtcttctgagcctg

SEQ ID NO: 209764 - DNA, 25 bp, E. coli
cacactggagcgacttctgagcctg

SEQ ID NO: 209765 - DNA, 25 bp, E. coli
cactctggccacactggagcgtctt

SEQ ID NO: 209766 - DNA, 25 bp, E. coli
cactctggccactctggagcgtctt

SEQ ID NO: 209767 - DNA, 25 bp, E. coli
ctgtcggcctttcaggtcgtggtat

SEQ ID NO: 209768 - DNA, 25 bp, E. coli
ctgtcggcctttgaggtcgtggtat

SEQ ID NO: 209769 - DNA, 25 bp, E. coli
atacggaggacgcttgtggcgcacg

SEQ ID NO: 209770 - DNA, 25 bp, E. coli
atacggaggacggttgtggcgcacg

SEQ ID NO: 209771 - DNA, 25 bp, E. coli
tacgcgtatgactggatacggagga

SEQ ID NO: 209772 - DNA, 25 bp, E. coli
tacgcgtatgacaggatacggagga

SEQ ID NO: 209773 - DNA, 25 bp, E. coli
tgattgtctgcgctgaaatggacga

SEQ ID NO: 209774 - DNA, 25 bp, E. coli
tgattgtctgcggtgaaatggacga

SEQ ID NO: 209775 - DNA, 25 bp, E. coli
tctgagcctgctgtcggcctttgag

SEQ ID NO: 209776 - DNA, 25 bp, E. coli
tctgagcctgctctcggcctttgag

SEQ ID NO: 209777 - DNA, 25 bp, E. coli
gtcttcggtgaacgcactctggcca

SEQ ID NO: 209778 - DNA, 25 bp, E. coli
gtcttcggtgaaggcactctggcca

SEQ ID NO: 209779 - DNA, 25 bp, E. coli
gtgctaaatcacgtcagcgctggct

SEQ ID NO: 209780 - DNA, 25 bp, E. coli
gtgctaaatcacctcagcgctggct

SEQ ID NO: 209781 - DNA, 25 bp, E. coli
gggctacgtcggtgctaaatcacgt

SEQ ID NO: 209782 - DNA, 25 bp, E. coli
gggctacgtcggagctaaatcacgt

SEQ ID NO: 209783 - DNA, 25 bp, E. coli
caatctggcattaacggcaggacac

SEQ ID NO: 209784 - DNA, 25 bp, E. coli
aatgacacgaccgaatcaccgtggg

SEQ ID NO: 209785 - DNA, 25 bp, E. coli
aaccattgctgttgtgttgggtgca

SEQ ID NO: 209786 - DNA, 25 bp, E. coli
aatgacacgacccaatcaccgtggg

SEQ ID NO: 209787 - DNA, 25 bp, E. coli
caatctggcatttacggcaggacac

SEQ ID NO: 209788 - DNA, 25 bp, E. coli
acggccagcggcaatttatgtacgg

SEQ ID NO: 209789 - DNA, 25 bp, E. coli
atagaaggccgcgttgatccgacac

SEQ ID NO: 209790 - DNA, 25 bp, E. coli
acggccagcggctatttatgtacgg

SEQ ID NO: 209791 - DNA, 25 bp, E. coli
atagaaggccgccttgatccgacac

SEQ ID NO: 209792 - DNA, 25 bp, E. coli
aaccattgctgtagtgttgggtgca

SEQ ID NO: 209793 - DNA, 25 bp, E. coli
tatttgagggagttaaagccgcgct

SEQ ID NO: 209794 - DNA, 25 bp, E. coli
tatgtacggcgaggctgattgcacc

SEQ ID NO: 209795 - DNA, 25 bp, E. coli
tatttgagggagataaagccgcgct

SEQ ID NO: 209796 - DNA, 25 bp, E. coli
tatgtacggcgacgctgattgcacc

SEQ ID NO: 209797 - DNA, 25 bp, E. coli
tgatccgacactcggaaagcggtta

SEQ ID NO: 209798 - DNA, 25 bp, E. coli
tgtttgcagatataccagacgttgc

SEQ ID NO: 209799 - DNA, 25 bp, E. coli
tgtttgcagataaaccagacgttgc

SEQ ID NO: 209800 - DNA, 25 bp, E. coli
tgatccgacactgggaaagcggtta

SEQ ID NO: 209801 - DNA, 25 bp, E. coli
tgatgatcgtgtcccagtgaatgac

SEQ ID NO: 209802 - DNA, 25 bp, E. coli
tgatgatcgtgtgccagtgaatgac

SEQ ID NO: 209803 - DNA, 25 bp, E. coli
ggcaaacgatgaggtcagcaccctg

SEQ ID NO: 209804 - DNA, 25 bp, E. coli
ggcaaacgatgacgtcagcaccctg

SEQ ID NO: 209805 - DNA, 25 bp, E. coli
aatcgcaccgtttgagttatagccg

SEQ ID NO: 209806 - DNA, 25 bp, E. coli
aatcgcaccgttagagttatagccg

SEQ ID NO: 209807 - DNA, 25 bp, E. coli
cagaaaatggaagaaatcgcaccgt

SEQ ID NO: 209808 - DNA, 25 bp, E. coli
cagaaaatggaacaaatcgcaccgt

SEQ ID NO: 209809 - DNA, 25 bp, E. coli
tactaggtactcttactgcggttgg

SEQ ID NO: 209810 - DNA, 25 bp, E. coli
tacggctctggcagctctaggtaca

SEQ ID NO: 209811 - DNA, 25 bp, E. coli
tactaggtactcatactgcggttgg

SEQ ID NO: 209812 - DNA, 25 bp, E. coli
tacggctctggctgctctaggtaca

SEQ ID NO: 209813 - DNA, 25 bp, E. coli
attgcagcggcaagctcggagacga

SEQ ID NO: 209814 - DNA, 25 bp, E. coli
attgcagcggcatgctcggagacga

SEQ ID NO: 209815 - DNA, 25 bp, E. coli
tatagccggatttgcacttaccact

SEQ ID NO: 209816 - DNA, 25 bp, E. coli
tatagccggattagcacttaccact

SEQ ID NO: 209817 - DNA, 25 bp, E. coli
ttctggtgcagtaatgccgctggcg

SEQ ID NO: 209818 - DNA, 25 bp, E. coli
ttctggtgcagttatgccgctggcg

SEQ ID NO: 209819 - DNA, 25 bp, E. coli
tctaggtacaggtattgcagcggca

SEQ ID NO: 209820 - DNA, 25 bp, E. coli
tcggagacgagcagcacagaatact

SEQ ID NO: 209821 - DNA, 25 bp, E. coli
tctaggtacaggaattgcagcggca

SEQ ID NO: 209822 - DNA, 25 bp, E. coli
tcggagacgagctgcacagaatact

SEQ ID NO: 209823 - DNA, 25 bp, E. coli
cctgggtattacatctggcgtacta

SEQ ID NO: 209824 - DNA, 25 bp, E. coli
cctgggtattacttctggcgtacta

SEQ ID NO: 209825 - DNA, 25 bp, E. coli
gctggcgacctcactcagtggaaat

SEQ ID NO: 209826 - DNA, 25 bp, E. coli
gctggcgacctctctcagtggaaat

SEQ ID NO: 209827 - DNA, 25 bp, E. coli
caatggcacgaagcatcactgggaa

SEQ ID NO: 209828 - DNA, 25 bp, E. coli
caatggcacgaaccatcactgggaa

SEQ ID NO: 209829 - DNA, 25 bp, E. coli
cactggctgcccaatattgaattgc

SEQ ID NO: 209830 - DNA, 25 bp, E. coli
cactggctgccctatattgaattgc

SEQ ID NO: 209831 - DNA, 25 bp, E. coli
tacagctcaacccatttaaacggtg

SEQ ID NO: 209832 - DNA, 25 bp, E. coli
tacagctcaaccgatttaaacggtg

SEQ ID NO: 209833 - DNA, 25 bp, E. coli
atgatttcaataccggcaatggcac

SEQ ID NO: 209834 - DNA, 25 bp, E. coli
atgatttcaatagcggcaatggcac

SEQ ID NO: 209835 - DNA, 25 bp, E. coli
taccgcattaaccagcactggctgc

SEQ ID NO: 209836 - DNA, 25 bp, E. coli
taccgcattaacgagcactggctgc

SEQ ID NO: 209837 - DNA, 25 bp, E. coli
ttggttagatcggaacgtggaaccg

SEQ ID NO: 209838 - DNA, 25 bp, E. coli
ttggttagatcgcaacgtggaaccg

SEQ ID NO: 209839 - DNA, 25 bp, E. coli
tgttaactacaaatttactccgtgg

SEQ ID NO: 209840 - DNA, 25 bp, E. coli
tgttaactacaattttactccgtgg

SEQ ID NO: 209841 - DNA, 25 bp, E. coli
gacagtgcgcaaccgttttaaccat

SEQ ID NO: 209842 - DNA, 25 bp, E. coli
gacagtgcgcaagcgttttaaccat

SEQ ID NO: 209843 - DNA, 25 bp, E. coli
cgagattggcaagtactggaacttt

SEQ ID NO: 209844 - DNA, 25 bp, E. coli
ccgtggtttaacctgacagtgcgca

SEQ ID NO: 209845 - DNA, 25 bp, E. coli
ccgtggtttaacgtgacagtgcgca

SEQ ID NO: 209846 - DNA, 25 bp, E. coli
cgagattggcaactactggaacttt

SEQ ID NO: 209847 - DNA, 25 bp, E. coli
taataatgacagctacgagattggc

SEQ ID NO: 209848 - DNA, 25 bp, E. coli
taataatgacaggtacgagattggc

SEQ ID NO: 209849 - DNA, 25 bp, E. coli
cttaggctggcgagttgactcccgg

SEQ ID NO: 209850 - DNA, 25 bp, E. coli
caccgtaggcgctgatatgttgctc

SEQ ID NO: 209851 - DNA, 25 bp, E. coli
cttaggctggcgtgttgactcccgg

SEQ ID NO: 209852 - DNA, 25 bp, E. coli
caccgtaggcgcagatatgttgctc

SEQ ID NO: 209853 - DNA, 25 bp, E. coli
caactggctggatgtcaccgtaggc

SEQ ID NO: 209854 - DNA, 25 bp, E. coli
caactggctggaagtcaccgtaggc

SEQ ID NO: 209855 - DNA, 25 bp, E. coli
tatggcatgccagcgtgagtacctt

SEQ ID NO: 209856 - DNA, 25 bp, E. coli
tacgcctggcaagaagaatatatcg

SEQ ID NO: 209857 - DNA, 25 bp, E. coli
tatggcatgccaccgtgagtacctt

SEQ ID NO: 209858 - DNA, 25 bp, E. coli
tacgcctggcaacaagaatatatcg

SEQ ID NO: 209859 - DNA, 25 bp, E. coli
gcccggtcgcgggattacattacga

SEQ ID NO: 209860 - DNA, 25 bp, E. coli
gcccggtcgcggcattacattacga

SEQ ID NO: 209861 - DNA, 25 bp, E. coli
gaaacccctgtggatgtgaccagca

SEQ ID NO: 209862 - DNA, 25 bp, E. coli
gaaacccctgtgcatgtgaccagca

SEQ ID NO: 209863 - DNA, 25 bp, E. coli
cgagaatatctgcaaggcgcaatca

SEQ ID NO: 209864 - DNA, 25 bp, E. coli
cgtattcaaagtagccaaagggcgc

SEQ ID NO: 209865 - DNA, 25 bp, E. coli
cgtattcaaagttgccaaagggcgc

SEQ ID NO: 209866 - DNA, 25 bp, E. coli
cgagaatatctggaaggcgcaatca

SEQ ID NO: 209867 - DNA, 25 bp, E. coli
gtcaatctggcgcaagaaacccctg

SEQ ID NO: 209868 - DNA, 25 bp, E. coli
gtcaatctggcggaagaaacccctg

SEQ ID NO: 209869 - DNA, 25 bp, E. coli
gaccctgggcgcaaatcagctataa

SEQ ID NO: 209870 - DNA, 25 bp, E. coli
gaccctgggcgctaatcagctataa

SEQ ID NO: 209871 - DNA, 25 bp, E. coli
aatgcttttcagatgcgctataacg

SEQ ID NO: 209872 - DNA, 25 bp, E. coli
aatgcttttcagttgcgctataacg

SEQ ID NO: 209873 - DNA, 25 bp, E. coli
cagaacctgctggaatggcatcgga

SEQ ID NO: 209874 - DNA, 25 bp, E. coli
cagaacctgctgcaatggcatcgga

SEQ ID NO: 209875 - DNA, 25 bp, E. coli
tacgcaggagaactcatgatctgga

SEQ ID NO: 209876 - DNA, 25 bp, E. coli
agaaaagcgattcgccgtctcagcg

SEQ ID NO: 209877 - DNA, 25 bp, E. coli
agaaaagcgattggccgtctcagcg

SEQ ID NO: 209878 - DNA, 25 bp, E. coli
aaaacgccgcgcaggtgttgctcat

SEQ ID NO: 209879 - DNA, 25 bp, E. coli
aaaacgccgcgctggtgttgctcat

SEQ ID NO: 209880 - DNA, 25 bp, E. coli
tacccgtggagtcgatggtcgatca

SEQ ID NO: 209881 - DNA, 25 bp, E. coli
tacccgtggagtggatggtcgatca

SEQ ID NO: 209882 - DNA, 25 bp, E. coli
tacgcaggagaagtcatgatctgga

SEQ ID NO: 209883 - DNA, 25 bp, E. coli
tataacgcgttctttcagcctgccg

SEQ ID NO: 209884 - DNA, 25 bp, E. coli
tataacgcgttcattcagcctgccg

SEQ ID NO: 209885 - DNA, 25 bp, E. coli
cattgtcgatggaagcgaacagaac

SEQ ID NO: 209886 - DNA, 25 bp, E. coli
cggatgagtcgcacctgcaaaacgc

SEQ ID NO: 209887 - DNA, 25 bp, E. coli
cattgtcgatggtagcgaacagaac

SEQ ID NO: 209888 - DNA, 25 bp, E. coli
cggatgagtcgctcctgcaaaacgc

SEQ ID NO: 209889 - DNA, 25 bp, E. coli
gatctggataatcctcgccacgctg

SEQ ID NO: 209890 - DNA, 25 bp, E. coli
gttttctgcgcgtaaccgaacctga

SEQ ID NO: 209891 - DNA, 25 bp, E. coli
gttttctgcgcgaaaccgaacctga

SEQ ID NO: 209892 - DNA, 25 bp, E. coli
gatctggataatgctcgccacgctg

SEQ ID NO: 209893 - DNA, 25 bp, E. coli
cagcaggccagcattgagatagcac

SEQ ID NO: 209894 - DNA, 25 bp, E. coli
cagtaaaattgcgatcaccgttgtc

SEQ ID NO: 209895 - DNA, 25 bp, E. coli
cagcaggccagctttgagatagcac

SEQ ID NO: 209896 - DNA, 25 bp, E. coli
cagtaaaattgccatcaccgttgtc

SEQ ID NO: 209897 - DNA, 25 bp, E. coli
agtcaggctcgttaccggttcgcag

SEQ ID NO: 209898 - DNA, 25 bp, E. coli
agtcaggctcgtaaccggttcgcag

SEQ ID NO: 209899 - DNA, 25 bp, E. coli
ttccggcgaacgacagtaaaattgc

SEQ ID NO: 209900 - DNA, 25 bp, E. coli
ttccggcgaacgtcagtaaaattgc

SEQ ID NO: 209901 - DNA, 25 bp, E. coli
gctgaatcttcagtaccctgccaaa

SEQ ID NO: 209902 - DNA, 25 bp, E. coli
gctttaaaggcgaacccgatacctg

SEQ ID NO: 209903 - DNA, 25 bp, E. coli
gctgaatcttcactaccctgccaaa

SEQ ID NO: 209904 - DNA, 25 bp, E. coli
gctttaaaggcgtacccgatacctg

SEQ ID NO: 209905 - DNA, 25 bp, E. coli
cgttgtcattgatggtgaagatacc

SEQ ID NO: 209906 - DNA, 25 bp, E. coli
cgttgtcattgaaggtgaagatacc

SEQ ID NO: 209907 - DNA, 25 bp, E. coli
gatagcactggatcgtgttccggcg

SEQ ID NO: 209908 - DNA, 25 bp, E. coli
gatacctgcctgatcatgcttaatg

SEQ ID NO: 209909 - DNA, 25 bp, E. coli
gatagcactggaacgtgttccggcg

SEQ ID NO: 209910 - DNA, 25 bp, E. coli
gatacctgcctgttcatgcttaatg

SEQ ID NO: 209911 - DNA, 25 bp, E. coli
ggacaaaacatagcccttcagcaat

SEQ ID NO: 209912 - DNA, 25 bp, E. coli
ggacaaaacataccccttcagcaat

SEQ ID NO: 209913 - DNA, 25 bp, E. coli
taatgctcagggtaaggtcagtggc

SEQ ID NO: 209914 - DNA, 25 bp, E. coli
taatgctcagggaaaggtcagtggc

SEQ ID NO: 209915 - DNA, 25 bp, E. coli
caatctggtgatcttataaccgcaa

SEQ ID NO: 209916 - DNA, 25 bp, E. coli
caatctggtgatgttataaccgcaa

SEQ ID NO: 209917 - DNA, 25 bp, E. coli
ctcgtcggaaattagaaaatggcca

SEQ ID NO: 209918 - DNA, 25 bp, E. coli
ctcgtcggaaataagaaaatggcca

SEQ ID NO: 209919 - DNA, 25 bp, E. coli
acaactgtgtttcgcacgctgtgca

SEQ ID NO: 209920 - DNA, 25 bp, E. coli
acaactgtgtttggcacgctgtgca

SEQ ID NO: 209921 - DNA, 25 bp, E. coli
tagttatgcaagttcccagggcatc

SEQ ID NO: 209922 - DNA, 25 bp, E. coli
tagttatgcaagatcccagggcatc

SEQ ID NO: 209923 - DNA, 25 bp, E. coli
tatctctgggcttatgtcatcagcg

SEQ ID NO: 209924 - DNA, 25 bp, E. coli
tatctctgggctaatgtcatcagcg

SEQ ID NO: 209925 - DNA, 25 bp, E. coli
tttgctcacatatctggaacactgg

SEQ ID NO: 209926 - DNA, 25 bp, E. coli
tttgctcacataactggaacactgg

SEQ ID NO: 209927 - DNA, 25 bp, E. coli
tgatttctaccacgatggtggcaca

SEQ ID NO: 209928 - DNA, 25 bp, E. coli
tgatttctaccaggatggtggcaca

SEQ ID NO: 209929 - DNA, 25 bp, E. coli
gcaggaaatttagctctctagagga

SEQ ID NO: 209930 - DNA, 25 bp, E. coli
gcaggaaatttacctctctagagga

SEQ ID NO: 209931 - DNA, 25 bp, E. coli
ggtggcacattaccgtcattaacaa

SEQ ID NO: 209932 - DNA, 25 bp, E. coli
ggtggcacattagcgtcattaacaa

SEQ ID NO: 209933 - DNA, 25 bp, E. coli
ggaattagctacatactcgtcggaa

SEQ ID NO: 209934 - DNA, 25 bp, E. coli
ggaacactggaattatgactacacc

SEQ ID NO: 209935 - DNA, 25 bp, E. coli
ggaacactggaaatatgactacacc

SEQ ID NO: 209936 - DNA, 25 bp, E. coli
ggaattagctacttactcgtcggaa

SEQ ID NO: 209937 - DNA, 25 bp, E. coli
cactttcattgtattaccgttgctc

SEQ ID NO: 209938 - DNA, 25 bp, E. coli
cactttcattgttttaccgttgctc

SEQ ID NO: 209939 - DNA, 25 bp, E. coli
tacttacccgcacaaatcattctgc

SEQ ID NO: 209940 - DNA, 25 bp, E. coli
tacttacccgcagaaatcattctgc

SEQ ID NO: 209941 - DNA, 25 bp, E. coli
ttctccataattggcgcaaaagtgt

SEQ ID NO: 209942 - DNA, 25 bp, E. coli
ttctccataattcgcgcaaaagtgt

SEQ ID NO: 209943 - DNA, 25 bp, E. coli
tcattctgcgggaattaagttgctt

SEQ ID NO: 209944 - DNA, 25 bp, E. coli
tcattctgcgggtattaagttgctt

SEQ ID NO: 209945 - DNA, 25 bp, E. coli
tcataatctctggaaaatcatcgtg

SEQ ID NO: 209946 - DNA, 25 bp, E. coli
tcataatctctgcaaaatcatcgtg

SEQ ID NO: 209947 - DNA, 25 bp, E. coli
ccagtcatccggaatagttcttcat

SEQ ID NO: 209948 - DNA, 25 bp, E. coli
gccgtaataaataactgaaaggaag

SEQ ID NO: 209949 - DNA, 25 bp, E. coli
gccgtaataaattactgaaaggaag

SEQ ID NO: 209950 - DNA, 25 bp, E. coli
ccagtcatccggtatagttcttcat

SEQ ID NO: 209951 - DNA, 25 bp, E. coli
gctctgattaattgacgctaaagtc

SEQ ID NO: 209952 - DNA, 25 bp, E. coli
gctaaagtcagtaaagttaatctcg

SEQ ID NO: 209953 - DNA, 25 bp, E. coli
gctaaagtcagttaagttaatctcg

SEQ ID NO: 209954 - DNA, 25 bp, E. coli
gctctgattaatagacgctaaagtc

SEQ ID NO: 209955 - DNA, 25 bp, E. coli
gttaatctcgtcaacacggcacgct

SEQ ID NO: 209956 - DNA, 25 bp, E. coli
gttaatctcgtctacacggcacgct

SEQ ID NO: 209957 - DNA, 25 bp, E. coli
ggcacgctacttaagaaagccgtaa

SEQ ID NO: 209958 - DNA, 25 bp, E. coli
ggcacgctactttagaaagccgtaa

SEQ ID NO: 209959 - DNA, 25 bp, E. coli
aagacgcgcattagttatcatcatc

SEQ ID NO: 209960 - DNA, 25 bp, E. coli
agatgaaattttggccactcacgag

SEQ ID NO: 209961 - DNA, 25 bp, E. coli
agatgaaattttcgccactcacgag

SEQ ID NO: 209962 - DNA, 25 bp, E. coli
aagacgcgcatttgttatcatcatc

SEQ ID NO: 209963 - DNA, 25 bp, E. coli
tatcatcatccctgaattccagaga

SEQ ID NO: 209964 - DNA, 25 bp, E. coli
tatcatcatcccagaattccagaga

SEQ ID NO: 209965 - DNA, 25 bp, E. coli
tgttatcatcatgcctgaattccag

SEQ ID NO: 209966 - DNA, 25 bp, E. coli
tgttatcatcatccctgaattccag

SEQ ID NO: 209967 - DNA, 25 bp, E. coli
tgaaattttggcgactcacgagtgg

SEQ ID NO: 209968 - DNA, 25 bp, E. coli
tgaaattttggccactcacgagtgg

SEQ ID NO: 209969 - DNA, 25 bp, E. coli
tccctgaattcctgagatgaaattt

SEQ ID NO: 209970 - DNA, 25 bp, E. coli
tccctgaattccagagatgaaattt

SEQ ID NO: 209971 - DNA, 25 bp, E. coli
tccagagatgaatttttggccactc

SEQ ID NO: 209972 - DNA, 25 bp, E. coli
tccagagatgaaattttggccactc

SEQ ID NO: 209973 - DNA, 25 bp, E. coli
gaattccagagaagaaattttggcc

SEQ ID NO: 209974 - DNA, 25 bp, E. coli
gaattccagagatgaaattttggcc

SEQ ID NO: 209975 - DNA, 25 bp, E. coli
gaaagacgcgcaattgttatcatca

SEQ ID NO: 209976 - DNA, 25 bp, E. coli
gaaattttggccactcacgagtggc

SEQ ID NO: 209977 - DNA, 25 bp, E. coli
gaaattttggcctctcacgagtggc

SEQ ID NO: 209978 - DNA, 25 bp, E. coli
gaaagacgcgcatttgttatcatca

SEQ ID NO: 209979 - DNA, 25 bp, E. coli
tggccactcacgagtggcctttttc

SEQ ID NO: 209980 - DNA, 25 bp, E. coli
tggccactcacgtgtggcctttttc

SEQ ID NO: 209981 - DNA, 25 bp, E. coli
cagggcttctctgagctgcgtgctg

SEQ ID NO: 209982 - DNA, 25 bp, E. coli
cagggcttctctcagctgcgtgctg

SEQ ID NO: 209983 - DNA, 25 bp, E. coli
aaagatcagcgtcttgccgcatcta

SEQ ID NO: 209984 - DNA, 25 bp, E. coli
aaagatcagcgtgttgccgcatcta

SEQ ID NO: 209985 - DNA, 25 bp, E. coli
tgttgccgcatcaaaagttctctct

SEQ ID NO: 209986 - DNA, 25 bp, E. coli
tgttgccgcatctaaagttctctct

SEQ ID NO: 209987 - DNA, 25 bp, E. coli
tgatgtcgttgcatatgcagtacag

SEQ ID NO: 209988 - DNA, 25 bp, E. coli
tgatgtcgttgcttatgcagtacag

SEQ ID NO: 209989 - DNA, 25 bp, E. coli
tgaaagatcagcctgttgccgcatc

SEQ ID NO: 209990 - DNA, 25 bp, E. coli
tgaaagatcagcgtgttgccgcatc

SEQ ID NO: 209991 - DNA, 25 bp, E. coli
tgcgtgatgtcgatgcttatgcagt

SEQ ID NO: 209992 - DNA, 25 bp, E. coli
tgcgtgatgtcgttgcttatgcagt

SEQ ID NO: 209993 - DNA, 25 bp, E. coli
tctgaaagatcaccgtgttgccgca

SEQ ID NO: 209994 - DNA, 25 bp, E. coli
tctgaaagatcagcgtgttgccgca

SEQ ID NO: 209995 - DNA, 25 bp, E. coli
gcttctctcagcagcgtgctgcgtc

SEQ ID NO: 209996 - DNA, 25 bp, E. coli
gcttctctcagctgcgtgctgcgtc

SEQ ID NO: 209997 - DNA, 25 bp, E. coli
cgtgttgccgcaactaaagttctct

SEQ ID NO: 209998 - DNA, 25 bp, E. coli
cgtgttgccgcatctaaagttctct

SEQ ID NO: 209999 - DNA, 25 bp, E. coli
gatcagcgtgttcccgcatctaaag

SEQ ID NO: 210000 - DNA, 25 bp, E. coli
gatcagcgtgttgccgcatctaaag

SEQ ID NO: 210001 - DNA, 25 bp, E. coli
gggcttctctcagctgcgtgctgcg

SEQ ID NO: 210002 - DNA, 25 bp, E. coli
gggcttctctcacctgcgtgctgcg

SEQ ID NO: 210003 - DNA, 25 bp, E. coli
caagcagggagaaaatacggtattc

SEQ ID NO: 210004 - DNA, 25 bp, E. coli
caagcagggagataatacggtattc

SEQ ID NO: 210005 - DNA, 25 bp, E. coli
caactaacggcagatgcgaatggca

SEQ ID NO: 210006 - DNA, 25 bp, E. coli
caactaacggcacatgcgaatggca

SEQ ID NO: 210007 - DNA, 25 bp, E. coli
tacagatgacgaaaccaactaacgg

SEQ ID NO: 210008 - DNA, 25 bp, E. coli
tacagatgacgataccaactaacgg

SEQ ID NO: 210009 - DNA, 25 bp, E. coli
tatcaaacagaaatgaggccatgct

SEQ ID NO: 210010 - DNA, 25 bp, E. coli
tatcaaacagaattgaggccatgct

SEQ ID NO: 210011 - DNA, 25 bp, E. coli
gcggaaaaggcgtgctacgaactta

SEQ ID NO: 210012 - DNA, 25 bp, E. coli
gcggaaaaggcgagctacgaactta

SEQ ID NO: 210013 - DNA, 25 bp, E. coli
gaaaacactaacgacgacgactact

SEQ ID NO: 210014 - DNA, 25 bp, E. coli
gacagacacctagctcatgacttgg

SEQ ID NO: 210015 - DNA, 25 bp, E. coli
gaaaacactaaccacgacgactact

SEQ ID NO: 210016 - DNA, 25 bp, E. coli
gacagacacctacctcatgacttgg

SEQ ID NO: 210017 - DNA, 25 bp, E. coli
gatatcattttcttgtgccaccgga

SEQ ID NO: 210018 - DNA, 25 bp, E. coli
gatatcattttcatgtgccaccgga

SEQ ID NO: 210019 - DNA, 25 bp, E. coli
taagtgatggcgatcttgactggcg

SEQ ID NO: 210020 - DNA, 25 bp, E. coli
tcaatgaggaatcgagagctgcgcc

SEQ ID NO: 210021 - DNA, 25 bp, E. coli
taagtgatggcgttcttgactggcg

SEQ ID NO: 210022 - DNA, 25 bp, E. coli
tcaatgaggaatggagagctgcgcc

SEQ ID NO: 210023 - DNA, 25 bp, E. coli
gagctgcgcctgagtttggatatca

SEQ ID NO: 210024 - DNA, 25 bp, E. coli
gagctgcgcctgtgtttggatatca

SEQ ID NO: 210025 - DNA, 25 bp, E. coli
tacaaatactggtaaaaccgtcctg

SEQ ID NO: 210026 - DNA, 25 bp, E. coli
taaatgaaccgcgagtctgtctgga

SEQ ID NO: 210027 - DNA, 25 bp, E. coli
taaatgaaccgccagtctgtctgga

SEQ ID NO: 210028 - DNA, 25 bp, E. coli
tacaaatactggaaaaaccgtcctg

SEQ ID NO: 210029 - DNA, 25 bp, E. coli
tgagcgacagttcgccgtaacggaa

SEQ ID NO: 210030 - DNA, 25 bp, E. coli
tgagcacgttgctatcccgaatcat

SEQ ID NO: 210031 - DNA, 25 bp, E. coli
tgagcgacagttggccgtaacggaa

SEQ ID NO: 210032 - DNA, 25 bp, E. coli
tgagcacgttgcaatcccgaatcat

SEQ ID NO: 210033 - DNA, 25 bp, E. coli
tcccgaatcatcttgagcgacagtt

SEQ ID NO: 210034 - DNA, 25 bp, E. coli
tcccgaatcatcatgagcgacagtt

SEQ ID NO: 210035 - DNA, 25 bp, E. coli
tcagggcgggcaaggatgcttaaat

SEQ ID NO: 210036 - DNA, 25 bp, E. coli
tcagggcgggcatggatgcttaaat

SEQ ID NO: 210037 - DNA, 25 bp, E. coli
cgtaacggaaccaaatcaggtgtgg

SEQ ID NO: 210038 - DNA, 25 bp, E. coli
cgtaacggaacctaatcaggtgtgg

SEQ ID NO: 210039 - DNA, 25 bp, E. coli
gggttcatcgcagcagctacaaata

SEQ ID NO: 210040 - DNA, 25 bp, E. coli
gggttcatcgcaccagctacaaata

SEQ ID NO: 210041 - DNA, 25 bp, E. coli
tggccactctctcccatgtgttcgg

SEQ ID NO: 210042 - DNA, 25 bp, E. coli
tggccactctctgccatgtgttcgg

SEQ ID NO: 210043 - DNA, 25 bp, E. coli
taagcgtggcggacatgagcacgtt

SEQ ID NO: 210044 - DNA, 25 bp, E. coli
taagcgtggcggtcatgagcacgtt

SEQ ID NO: 210045 - DNA, 25 bp, E. coli
gacctatagtgtgcccggagttcag

SEQ ID NO: 210046 - DNA, 25 bp, E. coli
gacctatagtgtccccggagttcag

SEQ ID NO: 210047 - DNA, 25 bp, E. coli
taacgcctgggataacgaagatttt

SEQ ID NO: 210048 - DNA, 25 bp, E. coli
aattgatgacatggttcggcgtggc

SEQ ID NO: 210049 - DNA, 25 bp, E. coli
taacgcctgggaaaacgaagatttt

SEQ ID NO: 210050 - DNA, 25 bp, E. coli
aattgatgacatcgttcggcgtggc

SEQ ID NO: 210051 - DNA, 25 bp, E. coli
agtttaaaaataacgtgctggcgct

SEQ ID NO: 210052 - DNA, 25 bp, E. coli
agtttaaaaatatcgtgctggcgct

SEQ ID NO: 210053 - DNA, 25 bp, E. coli
ttttgcttgttgttcaccaggctgg

SEQ ID NO: 210054 - DNA, 25 bp, E. coli
ttttgcttgttgatcaccaggctgg

SEQ ID NO: 210055 - DNA, 25 bp, E. coli
gaaattacccggcattcggcatggg

SEQ ID NO: 210056 - DNA, 25 bp, E. coli
gaaattacccgggattcggcatggg

SEQ ID NO: 210057 - DNA, 25 bp, E. coli
gactggcgacgtagttctctaacca

SEQ ID NO: 210058 - DNA, 25 bp, E. coli
gactggcgacgttgttctctaacca

SEQ ID NO: 210059 - DNA, 25 bp, E. coli
cgtcttgataaaaatgatgctgccg

SEQ ID NO: 210060 - DNA, 25 bp, E. coli
cgaagtttgcgtcgcattcccggcg

SEQ ID NO: 210061 - DNA, 25 bp, E. coli
cgtcttgataaatatgatgctgccg

SEQ ID NO: 210062 - DNA, 25 bp, E. coli
cgaagtttgcgtggcattcccggcg

SEQ ID NO: 210063 - DNA, 25 bp, E. coli
taatgatattgatggactggcgacg

SEQ ID NO: 210064 - DNA, 25 bp, E. coli
taattattgccggtgtggtaaccga

SEQ ID NO: 210065 - DNA, 25 bp, E. coli
taatgatattgaaggactggcgacg

SEQ ID NO: 210066 - DNA, 25 bp, E. coli
taattattgccgctgtggtaaccga

SEQ ID NO: 210067 - DNA, 25 bp, E. coli
gatgaccagttatgacacgttaacg

SEQ ID NO: 210068 - DNA, 25 bp, E. coli
gatgaccagttaagacacgttaacg

SEQ ID NO: 210069 - DNA, 25 bp, E. coli
cactgcaaatggatgcgcccggtat

SEQ ID NO: 210070 - DNA, 25 bp, E. coli
cactgcaaatggttgcgcccggtat

SEQ ID NO: 210071 - DNA, 25 bp, E. coli
caggcgtttaccgttagcgagagca

SEQ ID NO: 210072 - DNA, 25 bp, E. coli
caggcgtttacccttagcgagagca

SEQ ID NO: 210073 - DNA, 25 bp, E. coli
ttcctcggtacgcttggctccatca

SEQ ID NO: 210074 - DNA, 25 bp, E. coli
ttcctcggtacggttggctccatca

SEQ ID NO: 210075 - DNA, 25 bp, E. coli
tgtgcgcctgcaacgtgccaatagc

SEQ ID NO: 210076 - DNA, 25 bp, E. coli
tgtgcgcctgcatcgtgccaatagc

SEQ ID NO: 210077 - DNA, 25 bp, E. coli
tctggtctggaatcgaactctctcg

SEQ ID NO: 210078 - DNA, 25 bp, E. coli
tctggtctggaaacgaactctctcg

SEQ ID NO: 210079 - DNA, 25 bp, E. coli
ccatgcgccggatgccgtagtggaa

SEQ ID NO: 210080 - DNA, 25 bp, E. coli
ccatgcgccggaagccgtagtggaa

SEQ ID NO: 210081 - DNA, 25 bp, E. coli
gaacttgaaaatctggaaacgcaca

SEQ ID NO: 210082 - DNA, 25 bp, E. coli
gaacttgaaaatgtggaaacgcaca

SEQ ID NO: 210083 - DNA, 25 bp, E. coli
cgcgcgaagccgtagcgtttgaaga

SEQ ID NO: 210084 - DNA, 25 bp, E. coli
cgcccggtatcgcagaagcgttgat

SEQ ID NO: 210085 - DNA, 25 bp, E. coli
cgcccggtatcggagaagcgttgat

SEQ ID NO: 210086 - DNA, 25 bp, E. coli
cgcgcgaagccgaagcgtttgaaga

SEQ ID NO: 210087 - DNA, 25 bp, E. coli
gtattcttaacgcagcggcgcgcga

SEQ ID NO: 210088 - DNA, 25 bp, E. coli
gtattcttaacggagcggcgcgcga

SEQ ID NO: 210089 - DNA, 25 bp, E. coli
gggcggtaaaacaagcaacactgca

SEQ ID NO: 210090 - DNA, 25 bp, E. coli
gggcggtaaaactagcaacactgca

SEQ ID NO: 210091 - DNA, 25 bp, E. coli
aatgtgctgggaaaactgaactgcc

SEQ ID NO: 210092 - DNA, 25 bp, E. coli
aatgtgctgggataactgaactgcc

SEQ ID NO: 210093 - DNA, 25 bp, E. coli
taaaacggtacaagtgcatcgcgcc

SEQ ID NO: 210094 - DNA, 25 bp, E. coli
taaaacggtacatgtgcatcgcgcc

SEQ ID NO: 210095 - DNA, 25 bp, E. coli
tatctctgtgcccatgcgattcggg

SEQ ID NO: 210096 - DNA, 25 bp, E. coli
tatgacgcgccaacctttgtgcaaa

SEQ ID NO: 210097 - DNA, 25 bp, E. coli
tatctctgtgccgatgcgattcggg

SEQ ID NO: 210098 - DNA, 25 bp, E. coli
tatgacgcgccatcctttgtgcaaa

SEQ ID NO: 210099 - DNA, 25 bp, E. coli
tatttaaccaaaggctgtgggccgg

SEQ ID NO: 210100 - DNA, 25 bp, E. coli
tatttaaccaaacgctgtgggccgg

SEQ ID NO: 210101 - DNA, 25 bp, E. coli
tgaactggtacaatttgcgctcgac

SEQ ID NO: 210102 - DNA, 25 bp, E. coli
tgaactggtacattttgcgctcgac

SEQ ID NO: 210103 - DNA, 25 bp, E. coli
tcagtttgcttaagcgcctgcgtgc

SEQ ID NO: 210104 - DNA, 25 bp, E. coli
gcacaattactcactctggaagacg

SEQ ID NO: 210105 - DNA, 25 bp, E. coli
gcacaattactctctctggaagacg

SEQ ID NO: 210106 - DNA, 25 bp, E. coli
cgcgcaggcatggtcggcattaatc

SEQ ID NO: 210107 - DNA, 25 bp, E. coli
cgcgcaggcatgctcggcattaatc

SEQ ID NO: 210108 - DNA, 25 bp, E. coli
cattggtcagtagagtagtgccgcg

SEQ ID NO: 210109 - DNA, 25 bp, E. coli
cattggtcagtacagtagtgccgcg

SEQ ID NO: 210110 - DNA, 25 bp, E. coli
cattgatattgcgatgccggacgaa

SEQ ID NO: 210111 - DNA, 25 bp, E. coli
cattgatattgccatgccggacgaa

SEQ ID NO: 210112 - DNA, 25 bp, E. coli
tcagtttgcttatgcgcctgcgtgc

SEQ ID NO: 210113 - DNA, 25 bp, E. coli
aataaaatcagtacattgggcatgc

SEQ ID NO: 210114 - DNA, 25 bp, E. coli
aataaaatcagttcattgggcatgc

SEQ ID NO: 210115 - DNA, 25 bp, E. coli
aagcggtatcgctctggccattgct

SEQ ID NO: 210116 - DNA, 25 bp, E. coli
taaaagaggtctactcgccggaata

SEQ ID NO: 210117 - DNA, 25 bp, E. coli
taaaagaggtcttctcgccggaata

SEQ ID NO: 210118 - DNA, 25 bp, E. coli
accttgctttttggtatcggcatcg

SEQ ID NO: 210119 - DNA, 25 bp, E. coli
actggccattgcagcgctactttgc

SEQ ID NO: 210120 - DNA, 25 bp, E. coli
accttgctttttcgtatcggcatcg

SEQ ID NO: 210121 - DNA, 25 bp, E. coli
actggccattgctgcgctactttgc

SEQ ID NO: 210122 - DNA, 25 bp, E. coli
aagcggtatcgcactggccattgct

SEQ ID NO: 210123 - DNA, 25 bp, E. coli
ttggcggtatgcctaaggaaaatcg

SEQ ID NO: 210124 - DNA, 25 bp, E. coli
ttggcggtatgcgtaaggaaaatcg

SEQ ID NO: 210125 - DNA, 25 bp, E. coli
tgaaagcatcgtcgcggacaaaacg

SEQ ID NO: 210126 - DNA, 25 bp, E. coli
tgaaagcatcgtggcggacaaaacg

SEQ ID NO: 210127 - DNA, 25 bp, E. coli
tcggcatcgtgtgcagcattttgct

SEQ ID NO: 210128 - DNA, 25 bp, E. coli
tcggcatcgtgtccagcattttgct

SEQ ID NO: 210129 - DNA, 25 bp, E. coli
ggattatccacttttcattcggccc

SEQ ID NO: 210130 - DNA, 25 bp, E. coli
gggacgctggctttccataccttgc

SEQ ID NO: 210131 - DNA, 25 bp, E. coli
gggacgctggctatccataccttgc

SEQ ID NO: 210132 - DNA, 25 bp, E. coli
ggattatccactattcattcggccc

SEQ ID NO: 210133 - DNA, 25 bp, E. coli
tggcggacaaaagggctgaaattaa

SEQ ID NO: 210134 - DNA, 25 bp, E. coli
tggcggacaaaacggctgaaattaa

SEQ ID NO: 210135 - DNA, 25 bp, E. coli
aggagtatacctccgcagtgcggca

SEQ ID NO: 210136 - DNA, 25 bp, E. coli
aggagtatacctgcgcagtgcggca

SEQ ID NO: 210137 - DNA, 25 bp, E. coli
aaatctggcatcagcttgccgcgag

SEQ ID NO: 210138 - DNA, 25 bp, E. coli
aaaaaagcgtaaatctggcatctgc

SEQ ID NO: 210139 - DNA, 25 bp, E. coli
aaatctggcatctgcttgccgcgag

SEQ ID NO: 210140 - DNA, 25 bp, E. coli
aaaccaggaaaggagtatacctgcg

SEQ ID NO: 210141 - DNA, 25 bp, E. coli
aaaaaagcgtaattctggcatctgc

SEQ ID NO: 210142 - DNA, 25 bp, E. coli
aaaccaggaaagcagtatacctgcg

SEQ ID NO: 210143 - DNA, 25 bp, E. coli
tgcgcagtgcgggaaatacagccag

SEQ ID NO: 210144 - DNA, 25 bp, E. coli
tgccgcgagcggacgtatattttga

SEQ ID NO: 210145 - DNA, 25 bp, E. coli
tgcgcagtgcggcaaatacagccag

SEQ ID NO: 210146 - DNA, 25 bp, E. coli
tgccgcgagcggtcgtatattttga

SEQ ID NO: 210147 - DNA, 25 bp, E. coli
tcagaggctattttatcgattcagc

SEQ ID NO: 210148 - DNA, 25 bp, E. coli
tcagaggctattatatcgattcagc

SEQ ID NO: 210149 - DNA, 25 bp, E. coli
gcaaatacagcctgcgcgttaactg

SEQ ID NO: 210150 - DNA, 25 bp, E. coli
gcaaatacagccagcgcgttaactg

SEQ ID NO: 210151 - DNA, 25 bp, E. coli
cgttaactggaatgcaattttgcgg

SEQ ID NO: 210152 - DNA, 25 bp, E. coli
cgttaactggaaagcaattttgcgg

SEQ ID NO: 210153 - DNA, 25 bp, E. coli
cgtatattttgaacttcagaggcta

SEQ ID NO: 210154 - DNA, 25 bp, E. coli
cgtatattttgatcttcagaggcta

SEQ ID NO: 210155 - DNA, 25 bp, E. coli
gattcagctgtagtaaaattacgca

SEQ ID NO: 210156 - DNA, 25 bp, E. coli
gattcagctgtactaaaattacgca

SEQ ID NO: 210157 - DNA, 25 bp, E. coli
caaccgacaatggaaacgcaggatc

SEQ ID NO: 210158 - DNA, 25 bp, E. coli
caccaatgtgttacgccggatgcat

SEQ ID NO: 210159 - DNA, 25 bp, E. coli
caccaatgtgtttcgccggatgcat

SEQ ID NO: 210160 - DNA, 25 bp, E. coli
caaccgacaatgcaaacgcaggatc

SEQ ID NO: 210161 - DNA, 25 bp, E. coli
tacacgccttgcctaaagcggcacg

SEQ ID NO: 210162 - DNA, 25 bp, E. coli
tacacgccttgcgtaaagcggcacg

SEQ ID NO: 210163 - DNA, 25 bp, E. coli
agtagggtccagtaatctcgatccg

SEQ ID NO: 210164 - DNA, 25 bp, E. coli
agtagggtccagaaatctcgatccg

SEQ ID NO: 210165 - DNA, 25 bp, E. coli
tagctggcgcgatggcaataagatc

SEQ ID NO: 210166 - DNA, 25 bp, E. coli
tagctggcgcgaaggcaataagatc

SEQ ID NO: 210167 - DNA, 25 bp, E. coli
tattgctggtctcgcgcgataacga

SEQ ID NO: 210168 - DNA, 25 bp, E. coli
tattgctggtctggcgcgataacga

SEQ ID NO: 210169 - DNA, 25 bp, E. coli
tataactatctggttaaaggcggcg

SEQ ID NO: 210170 - DNA, 25 bp, E. coli
tataactatctgcttaaaggcggcg

SEQ ID NO: 210171 - DNA, 25 bp, E. coli
tatctggtttgaggatgacgtcggc

SEQ ID NO: 210172 - DNA, 25 bp, E. coli
tatctggtttgacgatgacgtcggc

SEQ ID NO: 210173 - DNA, 25 bp, E. coli
cattgatggacgatcactgggcgac

SEQ ID NO: 210174 - DNA, 25 bp, E. coli
cattcagggcgatccggatatgccg

SEQ ID NO: 210175 - DNA, 25 bp, E. coli
cattgatggacgttcactgggcgac

SEQ ID NO: 210176 - DNA, 25 bp, E. coli
cattcagggcgaaccggatatgccg

SEQ ID NO: 210177 - DNA, 25 bp, E. coli
tcaatgaactgagggcagctggcgt

SEQ ID NO: 210178 - DNA, 25 bp, E. coli
tcaatgaactgacggcagctggcgt

SEQ ID NO: 210179 - DNA, 25 bp, E. coli
aatactggaatttctgaacaggcat

SEQ ID NO: 210180 - DNA, 25 bp, E. coli
aatactggaattactgaacaggcat

SEQ ID NO: 210181 - DNA, 25 bp, E. coli
cagcgctcaccattaagacggggca

SEQ ID NO: 210182 - DNA, 25 bp, E. coli
cagcgctcaccaataagacggggca

SEQ ID NO: 210183 - DNA, 25 bp, E. coli
aaatactggaatatctgaacaggca

SEQ ID NO: 210184 - DNA, 25 bp, E. coli
aaatactggaatttctgaacaggca

SEQ ID NO: 210185 - DNA, 25 bp, E. coli
ttcagcgctcaccattaagacgggg

SEQ ID NO: 210186 - DNA, 25 bp, E. coli
ttcagcgctcacgattaagacgggg

SEQ ID NO: 210187 - DNA, 25 bp, E. coli
tgaaatactggaatttctgaacagg

SEQ ID NO: 210188 - DNA, 25 bp, E. coli
tgaaatactggattttctgaacagg

SEQ ID NO: 210189 - DNA, 25 bp, E. coli
gcgctcaccattaagacggggcatg

SEQ ID NO: 210190 - DNA, 25 bp, E. coli
gcgctcaccatttagacggggcatg

SEQ ID NO: 210191 - DNA, 25 bp, E. coli
gaatgaaatactcgaatttctgaac

SEQ ID NO: 210192 - DNA, 25 bp, E. coli
gaatgaaatactggaatttctgaac

SEQ ID NO: 210193 - DNA, 25 bp, E. coli
gaagaatgaaattctggaatttctg

SEQ ID NO: 210194 - DNA, 25 bp, E. coli
gaagaatgaaatactggaatttctg

SEQ ID NO: 210195 - DNA, 25 bp, E. coli
gaaatactggaaattctgaacaggc

SEQ ID NO: 210196 - DNA, 25 bp, E. coli
gaaatactggaatttctgaacaggc

SEQ ID NO: 210197 - DNA, 25 bp, E. coli
gttcagcgctcagcattaagacggg

SEQ ID NO: 210198 - DNA, 25 bp, E. coli
gttcagcgctcaccattaagacggg

SEQ ID NO: 210199 - DNA, 25 bp, E. coli
tcaccattaagacggggcatggcaa

SEQ ID NO: 210200 - DNA, 25 bp, E. coli
tcaccattaagagggggcatggcaa

SEQ ID NO: 210201 - DNA, 25 bp, E. coli
taaacattctcgtctggcaggcaag

SEQ ID NO: 210202 - DNA, 25 bp, E. coli
taaacattctcgactggcaggcaag

SEQ ID NO: 210203 - DNA, 25 bp, E. coli
agtggtcacgtctgcctcaggcaat

SEQ ID NO: 210204 - DNA, 25 bp, E. coli
attctcgactgggaggcaagagcgc

SEQ ID NO: 210205 - DNA, 25 bp, E. coli
attctcgactggcaggcaagagcgc

SEQ ID NO: 210206 - DNA, 25 bp, E. coli
agtggtcacgtcagcctcaggcaat

SEQ ID NO: 210207 - DNA, 25 bp, E. coli
tgcaatggcaggtgtggtcacgtca

SEQ ID NO: 210208 - DNA, 25 bp, E. coli
tgcaatggcaggagtggtcacgtca

SEQ ID NO: 210209 - DNA, 25 bp, E. coli
gcctggacttagtgaaacgctgcaa

SEQ ID NO: 210210 - DNA, 25 bp, E. coli
gcctggacttagagaaacgctgcaa

SEQ ID NO: 210211 - DNA, 25 bp, E. coli
gcaattgacccgacagcaccgttgg

SEQ ID NO: 210212 - DNA, 25 bp, E. coli
gcaagagcgcctcgacttagtgaaa

SEQ ID NO: 210213 - DNA, 25 bp, E. coli
gcaagagcgcctggacttagtgaaa

SEQ ID NO: 210214 - DNA, 25 bp, E. coli
gcaattgacccgtcagcaccgttgg

SEQ ID NO: 210215 - DNA, 25 bp, E. coli
gaaatttgcattaaacattctcgac

SEQ ID NO: 210216 - DNA, 25 bp, E. coli
gaaatttgcatttaacattctcgac

SEQ ID NO: 210217 - DNA, 25 bp, E. coli
cttagtgaaacgctgcaatggcagg

SEQ ID NO: 210218 - DNA, 25 bp, E. coli
cttagtgaaacggtgcaatggcagg

SEQ ID NO: 210219 - DNA, 25 bp, E. coli
cattaaacattctcgactggcaggc

SEQ ID NO: 210220 - DNA, 25 bp, E. coli
cattaaacattcacgactggcaggc

SEQ ID NO: 210221 - DNA, 25 bp, E. coli
gtcagcctcaggcaattgacccgac

SEQ ID NO: 210222 - DNA, 25 bp, E. coli
gtcagcctcagggaattgacccgac

SEQ ID NO: 210223 - DNA, 25 bp, E. coli
aatcaactgagtcctgaacaggcgc

SEQ ID NO: 210224 - DNA, 25 bp, E. coli
aatcaactgagtgctgaacaggcgc

SEQ ID NO: 210225 - DNA, 25 bp, E. coli
caaaaccggtgatctgtgcagtcaa

SEQ ID NO: 210226 - DNA, 25 bp, E. coli
caaaaccggtgaactgtgcagtcaa

SEQ ID NO: 210227 - DNA, 25 bp, E. coli
tgagatgcacgcacaactggcagag

SEQ ID NO: 210228 - DNA, 25 bp, E. coli
tgatgaaacgctcgcagataccgcg

SEQ ID NO: 210229 - DNA, 25 bp, E. coli
tgatgaaacgctggcagataccgcg

SEQ ID NO: 210230 - DNA, 25 bp, E. coli
tgagatgcacgctcaactggcagag

SEQ ID NO: 210231 - DNA, 25 bp, E. coli
tcctcagtcatgtagaaaagggcgt

SEQ ID NO: 210232 - DNA, 25 bp, E. coli
tcctcagtcatgaagaaaagggcgt

SEQ ID NO: 210233 - DNA, 25 bp, E. coli
tctggcgacacaaccgacatttggt

SEQ ID NO: 210234 - DNA, 25 bp, E. coli
tctggcgacacatccgacatttggt

SEQ ID NO: 210235 - DNA, 25 bp, E. coli
cgcaactggatctggaacgtgacta

SEQ ID NO: 210236 - DNA, 25 bp, E. coli
cgcaactggatcaggaacgtgacta

SEQ ID NO: 210237 - DNA, 25 bp, E. coli
ctgttacttacaggtgccgggcgcg

SEQ ID NO: 210238 - DNA, 25 bp, E. coli
ctgttacttacacgtgccgggcgcg

SEQ ID NO: 210239 - DNA, 25 bp, E. coli
gtgactatcagcgacttgccggacg

SEQ ID NO: 210240 - DNA, 25 bp, E. coli
gtgactatcagccacttgccggacg

SEQ ID NO: 210241 - DNA, 25 bp, E. coli
taatacccgattccggtggaacctg

SEQ ID NO: 210242 - DNA, 25 bp, E. coli
taatacccgattgcggtggaacctg

SEQ ID NO: 210243 - DNA, 25 bp, E. coli
gatcgtaacgttgatcccacaggcc

SEQ ID NO: 210244 - DNA, 25 bp, E. coli
gatcgtaacgttcatcccacaggcc

SEQ ID NO: 210245 - DNA, 25 bp, E. coli
aattacagcagggagtggatcaggc

SEQ ID NO: 210246 - DNA, 25 bp, E. coli
caatttcactcagttaacggcggac

SEQ ID NO: 210247 - DNA, 25 bp, E. coli
caatttcactcacttaacggcggac

SEQ ID NO: 210248 - DNA, 25 bp, E. coli
aattacagcaggcagtggatcaggc

SEQ ID NO: 210249 - DNA, 25 bp, E. coli
cactggtaaatgctggcgctattgc

SEQ ID NO: 210250 - DNA, 25 bp, E. coli
cactggtaaatggtggcgctattgc

SEQ ID NO: 210251 - DNA, 25 bp, E. coli
cataaacgcgttcttcaggccgaca

SEQ ID NO: 210252 - DNA, 25 bp, E. coli
cataaacgcgttgttcaggccgaca

SEQ ID NO: 210253 - DNA, 25 bp, E. coli
ttagagttgcatcgcggcaaaccgc

SEQ ID NO: 210254 - DNA, 25 bp, E. coli
ttgaactggcaacgcttggcgcgac

SEQ ID NO: 210255 - DNA, 25 bp, E. coli
ttagagttgcatggcggcaaaccgc

SEQ ID NO: 210256 - DNA, 25 bp, E. coli
ttgaactggcaaggcttggcgcgac

SEQ ID NO: 210257 - DNA, 25 bp, E. coli
tgtgatgcaatgcaagcctgtgacg

SEQ ID NO: 210258 - DNA, 25 bp, E. coli
tgtgatgcaatggaagcctgtgacg

SEQ ID NO: 210259 - DNA, 25 bp, E. coli
tgttcgcggtcaaaaaatggtggca

SEQ ID NO: 210260 - DNA, 25 bp, E. coli
tgttcgcggtcataaaatggtggca

SEQ ID NO: 210261 - DNA, 25 bp, E. coli
ccttgcgttagaagatgtcggcccg

SEQ ID NO: 210262 - DNA, 25 bp, E. coli
ccttgcgttagatgatgtcggcccg

SEQ ID NO: 210263 - DNA, 25 bp, E. coli
gaaagtctgtacgttagcccttgcg

SEQ ID NO: 210264 - DNA, 25 bp, E. coli
gaaagtctgtaccttagcccttgcg

SEQ ID NO: 210265 - DNA, 25 bp, E. coli
tggcatcggtcgctaagcaactcgg

SEQ ID NO: 210266 - DNA, 25 bp, E. coli
tggcatcggtcggtaagcaactcgg

SEQ ID NO: 210267 - DNA, 25 bp, E. coli
catcaagtcttatctgccggacagc

SEQ ID NO: 210268 - DNA, 25 bp, E. coli
ctttaaccgctacggcaaggtgacg

SEQ ID NO: 210269 - DNA, 25 bp, E. coli
catcaagtcttaactgccggacagc

SEQ ID NO: 210270 - DNA, 25 bp, E. coli
ctttaaccgctagggcaaggtgacg

SEQ ID NO: 210271 - DNA, 25 bp, E. coli
tgtataccgcgctgattaaccttga

SEQ ID NO: 210272 - DNA, 25 bp, E. coli
tgtataccgcgcagattaaccttga

SEQ ID NO: 210273 - DNA, 25 bp, E. coli
tgctgaagaaatcacggaaggtccg

SEQ ID NO: 210274 - DNA, 25 bp, E. coli
tgcataatgccgtggagctggtcgc

SEQ ID NO: 210275 - DNA, 25 bp, E. coli
tgcataatgccgaggagctggtcgc

SEQ ID NO: 210276 - DNA, 25 bp, E. coli
tgctgaagaaatgacggaaggtccg

SEQ ID NO: 210277 - DNA, 25 bp, E. coli
tcacctctatggaagtcagcccgaa

SEQ ID NO: 210278 - DNA, 25 bp, E. coli
tctgggtacggatatgctgacattc

SEQ ID NO: 210279 - DNA, 25 bp, E. coli
tcacctctatggtagtcagcccgaa

SEQ ID NO: 210280 - DNA, 25 bp, E. coli
tctgggtacggaaatgctgacattc

SEQ ID NO: 210281 - DNA, 25 bp, E. coli
gaagaacgcctgactgagctggaga

SEQ ID NO: 210282 - DNA, 25 bp, E. coli
gaagaaatccagcaggacaagccgt

SEQ ID NO: 210283 - DNA, 25 bp, E. coli
gaagaacgcctgtctgagctggaga

SEQ ID NO: 210284 - DNA, 25 bp, E. coli
gaagaaatccaggaggacaagccgt

SEQ ID NO: 210285 - DNA, 25 bp, E. coli
gatacgggcaaagcctacctggtcg

SEQ ID NO: 210286 - DNA, 25 bp, E. coli
gatacgggcaaaccctacctggtcg

SEQ ID NO: 210287 - DNA, 25 bp, E. coli
gtcacggcgctgatcaccaaaaaag

SEQ ID NO: 210288 - DNA, 25 bp, E. coli
gtcacggcgctgttcaccaaaaaag

SEQ ID NO: 210289 - DNA, 25 bp, E. coli
cacgggcggtatactcacgcattca

SEQ ID NO: 210290 - DNA, 25 bp, E. coli
cacgggcggtattctcacgcattca

SEQ ID NO: 210291 - DNA, 25 bp, E. coli
tgtcaggctgccatattccgaacgc

SEQ ID NO: 210292 - DNA, 25 bp, E. coli
tgtcaggctgccttattccgaacgc

SEQ ID NO: 210293 - DNA, 25 bp, E. coli
tgaactcccgctcagtaacaccgtg

SEQ ID NO: 210294 - DNA, 25 bp, E. coli
tgaactcccgctgagtaacaccgtg

SEQ ID NO: 210295 - DNA, 25 bp, E. coli
gcgggttcgaggttaagaaagctct

SEQ ID NO: 210296 - DNA, 25 bp, E. coli
gcgggttcgaggataagaaagctct

SEQ ID NO: 210297 - DNA, 25 bp, E. coli
gaaagctctcagtctcgactatcgg

SEQ ID NO: 210298 - DNA, 25 bp, E. coli
gactatcggcactggataatctctg

SEQ ID NO: 210299 - DNA, 25 bp, E. coli
gaaagctctcagactcgactatcgg

SEQ ID NO: 210300 - DNA, 25 bp, E. coli
gactatcggcacaggataatctctg

SEQ ID NO: 210301 - DNA, 25 bp, E. coli
cgatggcacgcatcgcaaaatatta

SEQ ID NO: 210302 - DNA, 25 bp, E. coli
ccgtgccaccggtgaaaaccgatgg

SEQ ID NO: 210303 - DNA, 25 bp, E. coli
cgatggcacgcaacgcaaaatatta

SEQ ID NO: 210304 - DNA, 25 bp, E. coli
ccgtgccaccggagaaaaccgatgg

SEQ ID NO: 210305 - DNA, 25 bp, E. coli
gattcattcttaccgcaggcgcggg

SEQ ID NO: 210306 - DNA, 25 bp, E. coli
gataattcgcccgttcttgcctgca

SEQ ID NO: 210307 - DNA, 25 bp, E. coli
gattcattcttagcgcaggcgcggg

SEQ ID NO: 210308 - DNA, 25 bp, E. coli
gataattcgccccttcttgcctgca

SEQ ID NO: 210309 - DNA, 25 bp, E. coli
tcaagtctgaatcgttccagcaccc

SEQ ID NO: 210310 - DNA, 25 bp, E. coli
tcaagtctgaatggttccagcaccc

SEQ ID NO: 210311 - DNA, 25 bp, E. coli
tgcactgctaaaattcgaacaagga

SEQ ID NO: 210312 - DNA, 25 bp, E. coli
tgcactgctaaatttcgaacaagga

SEQ ID NO: 210313 - DNA, 25 bp, E. coli
tcggctaaaatagagactacatgtc

SEQ ID NO: 210314 - DNA, 25 bp, E. coli
tctcacttaaggtgtgtagttccgt

SEQ ID NO: 210315 - DNA, 25 bp, E. coli
tctttttcagaaggtcgaacgggat

SEQ ID NO: 210316 - DNA, 25 bp, E. coli
tctttttcagaacgtcgaacgggat

SEQ ID NO: 210317 - DNA, 25 bp, E. coli
tcggctaaaatacagactacatgtc

SEQ ID NO: 210318 - DNA, 25 bp, E. coli
tctcacttaaggagtgtagttccgt

SEQ ID NO: 210319 - DNA, 25 bp, E. coli
gctggtaatctcaaaaaagatggca

SEQ ID NO: 210320 - DNA, 25 bp, E. coli
gctggtaatctctaaaaagatggca

SEQ ID NO: 210321 - DNA, 25 bp, E. coli
gacgcgttcatcttcgtcaaagata

SEQ ID NO: 210322 - DNA, 25 bp, E. coli
cgaacaaggaattttctgctggtaa

SEQ ID NO: 210323 - DNA, 25 bp, E. coli
cgaacaaggaatattctgctggtaa

SEQ ID NO: 210324 - DNA, 25 bp, E. coli
gatacattgagcaaagacgcgttca

SEQ ID NO: 210325 - DNA, 25 bp, E. coli
gttcatcggatatgatatagtcacg

SEQ ID NO: 210326 - DNA, 25 bp, E. coli
gttcatcggataagatatagtcacg

SEQ ID NO: 210327 - DNA, 25 bp, E. coli
tgtcttcggtccttctcacttaagg

SEQ ID NO: 210328 - DNA, 25 bp, E. coli
tgtcttcggtccatctcacttaagg

SEQ ID NO: 210329 - DNA, 25 bp, E. coli
gatacattgagctaagacgcgttca

SEQ ID NO: 210330 - DNA, 25 bp, E. coli
taagtttttccaaagcttgcactgc

SEQ ID NO: 210331 - DNA, 25 bp, E. coli
taagtttttccatagcttgcactgc

SEQ ID NO: 210332 - DNA, 25 bp, E. coli
gacgcgttcatcatcgtcaaagata

SEQ ID NO: 210333 - DNA, 25 bp, E. coli
caccggatcgcgcagaggcgttata

SEQ ID NO: 210334 - DNA, 25 bp, E. coli
caaaccgtctgtccgagcgtgtgct

SEQ ID NO: 210335 - DNA, 25 bp, E. coli
caccggatcgcggagaggcgttata

SEQ ID NO: 210336 - DNA, 25 bp, E. coli
caaaccgtctgtgcgagcgtgtgct

SEQ ID NO: 210337 - DNA, 25 bp, E. coli
caaacaggacgcatcgctgcggata

SEQ ID NO: 210338 - DNA, 25 bp, E. coli
caaacaggacgcttcgctgcggata

SEQ ID NO: 210339 - DNA, 25 bp, E. coli
catctttagcgaagccgaaggcaag

SEQ ID NO: 210340 - DNA, 25 bp, E. coli
catctttagcgatgccgaaggcaag

SEQ ID NO: 210341 - DNA, 25 bp, E. coli
tatttcgtcgaaggctgccgtcagc

SEQ ID NO: 210342 - DNA, 25 bp, E. coli
tatttcgtcgaacgctgccgtcagc

SEQ ID NO: 210343 - DNA, 25 bp, E. coli
tgatggccccgtcacattctggttg

SEQ ID NO: 210344 - DNA, 25 bp, E. coli
tgatggccccgtgacattctggttg

SEQ ID NO: 210345 - DNA, 25 bp, E. coli
tgacgacgaacacaaagcaaaccgt

SEQ ID NO: 210346 - DNA, 25 bp, E. coli
tgacgacgaacagaaagcaaaccgt

SEQ ID NO: 210347 - DNA, 25 bp, E. coli
tgccgtcagcaagagatgaacacgc

SEQ ID NO: 210348 - DNA, 25 bp, E. coli
tgccgtcagcaacagatgaacacgc

SEQ ID NO: 210349 - DNA, 25 bp, E. coli
cggatatgcaggaatcgctggtcaa

SEQ ID NO: 210350 - DNA, 25 bp, E. coli
cggatatgcaggtatcgctggtcaa

SEQ ID NO: 210351 - DNA, 25 bp, E. coli
ggatgcgcccaagtttctccaaagg

SEQ ID NO: 210352 - DNA, 25 bp, E. coli
ggatgcgcccaactttctccaaagg

SEQ ID NO: 210353 - DNA, 25 bp, E. coli
taattcaacgcgaaacccgtgccag

SEQ ID NO: 210354 - DNA, 25 bp, E. coli
taattcaacgcgtaacccgtgccag

SEQ ID NO: 210355 - DNA, 25 bp, E. coli
caattcaagttcctattggtatggt

SEQ ID NO: 210356 - DNA, 25 bp, E. coli
caattcaagttcgtattggtatggt

SEQ ID NO: 210357 - DNA, 25 bp, E. coli
cagatggcaagcagccctagcaggt

SEQ ID NO: 210358 - DNA, 25 bp, E. coli
cagatggcaagctgccctagcaggt

SEQ ID NO: 210359 - DNA, 25 bp, E. coli
tagcggctcacaattcaagttcgta

SEQ ID NO: 210360 - DNA, 25 bp, E. coli
tagttgccttgctgccagtcctggc

SEQ ID NO: 210361 - DNA, 25 bp, E. coli
tagcggctcacatttcaagttcgta

SEQ ID NO: 210362 - DNA, 25 bp, E. coli
tagttgccttgcagccagtcctggc

SEQ ID NO: 210363 - DNA, 25 bp, E. coli
ttgaaaaggcattgcggctcacaat

SEQ ID NO: 210364 - DNA, 25 bp, E. coli
ttgaaaaggcatagcggctcacaat

SEQ ID NO: 210365 - DNA, 25 bp, E. coli
tgccagtcctgggaaaagtgcaggc

SEQ ID NO: 210366 - DNA, 25 bp, E. coli
tgccagtcctggcaaaagtgcaggc

SEQ ID NO: 210367 - DNA, 25 bp, E. coli
tctcgagtgcagttggcaagctgcc

SEQ ID NO: 210368 - DNA, 25 bp, E. coli
tctcgagtgcagatggcaagctgcc

SEQ ID NO: 210369 - DNA, 25 bp, E. coli
gcaagctgccctagcaggtcacgtc

SEQ ID NO: 210370 - DNA, 25 bp, E. coli
gcaagctgcccttgcaggtcacgtc

SEQ ID NO: 210371 - DNA, 25 bp, E. coli
cgcaggctctcgagtgcagatggca

SEQ ID NO: 210372 - DNA, 25 bp, E. coli
cgcaggctctcgtgtgcagatggca

SEQ ID NO: 210373 - DNA, 25 bp, E. coli
tggcaaaagtgcaggcgcaggctct

SEQ ID NO: 210374 - DNA, 25 bp, E. coli
tggcaaaagtgctggcgcaggctct

SEQ ID NO: 210375 - DNA, 25 bp, E. coli
tggtatggttagttgccttgctgcc

SEQ ID NO: 210376 - DNA, 25 bp, E. coli
tggtatggttagatgccttgctgcc

SEQ ID NO: 210377 - DNA, 25 bp, E. coli
aatgacgcgtcgttgcagacagccg

SEQ ID NO: 210378 - DNA, 25 bp, E. coli
aatgacgcgtcgatgcagacagccg

SEQ ID NO: 210379 - DNA, 25 bp, E. coli
tacgaccggtgagttgaatgacgcg

SEQ ID NO: 210380 - DNA, 25 bp, E. coli
atgcgcgagagtgctacgaccggtg

SEQ ID NO: 210381 - DNA, 25 bp, E. coli
atgactggagtcaggcaaccgtcgc

SEQ ID NO: 210382 - DNA, 25 bp, E. coli
atgactggagtctggcaaccgtcgc

SEQ ID NO: 210383 - DNA, 25 bp, E. coli
atgcgcgagagtcctacgaccggtg

SEQ ID NO: 210384 - DNA, 25 bp, E. coli
tacgaccggtgacttgaatgacgcg

SEQ ID NO: 210385 - DNA, 25 bp, E. coli
tttccgatgactcgagtctggcaac

SEQ ID NO: 210386 - DNA, 25 bp, E. coli
tttccgatgactggagtctggcaac

SEQ ID NO: 210387 - DNA, 25 bp, E. coli
tgaatgacgcgtcgttgcagacagc

SEQ ID NO: 210388 - DNA, 25 bp, E. coli
tgctacgaccggagagttgaatgac

SEQ ID NO: 210389 - DNA, 25 bp, E. coli
tgctacgaccggtgagttgaatgac

SEQ ID NO: 210390 - DNA, 25 bp, E. coli
tgaatgacgcgtggttgcagacagc

SEQ ID NO: 210391 - DNA, 25 bp, E. coli
ccggtgagttgaatgacgcgtcgtt

SEQ ID NO: 210392 - DNA, 25 bp, E. coli
ccggtgagttgattgacgcgtcgtt

SEQ ID NO: 210393 - DNA, 25 bp, E. coli
cgatgactggagactggcaaccgtc

SEQ ID NO: 210394 - DNA, 25 bp, E. coli
ctggagtctggctaccgtcgccgga

SEQ ID NO: 210395 - DNA, 25 bp, E. coli
cgatgactggagtctggcaaccgtc

SEQ ID NO: 210396 - DNA, 25 bp, E. coli
ctggagtctggcaaccgtcgccgga

SEQ ID NO: 210397 - DNA, 25 bp, E. coli
gtgagttgaatgtcgcgtcgttgca

SEQ ID NO: 210398 - DNA, 25 bp, E. coli
gtgagttgaatgacgcgtcgttgca

SEQ ID NO: 210399 - DNA, 25 bp, E. coli
ctatccgcaacacccgggcgtggta

SEQ ID NO: 210400 - DNA, 25 bp, E. coli
ctatccgcaacagccgggcgtggta

SEQ ID NO: 210401 - DNA, 25 bp, E. coli
aacgaaccgccgttggccgatgcgc

SEQ ID NO: 210402 - DNA, 25 bp, E. coli
aaacgtagaaaccaacatgcccgag

SEQ ID NO: 210403 - DNA, 25 bp, E. coli
aaacgtagaaacgaacatgcccgag

SEQ ID NO: 210404 - DNA, 25 bp, E. coli
aacgaaccgccgatggccgatgcgc

SEQ ID NO: 210405 - DNA, 25 bp, E. coli
tttctcccgcacagggctggatatt

SEQ ID NO: 210406 - DNA, 25 bp, E. coli
ttaaacgtagaaaccaacatgcccg

SEQ ID NO: 210407 - DNA, 25 bp, E. coli
tttctcccgcactgggctggatatt

SEQ ID NO: 210408 - DNA, 25 bp, E. coli
ttaaacgtagaatccaacatgcccg

SEQ ID NO: 210409 - DNA, 25 bp, E. coli
tgcttccagccggttaaacgtagaa

SEQ ID NO: 210410 - DNA, 25 bp, E. coli
tgcttccagccgcttaaacgtagaa

SEQ ID NO: 210411 - DNA, 25 bp, E. coli
tgacattgctcgttaaaaacccgca

SEQ ID NO: 210412 - DNA, 25 bp, E. coli
tgacattgctcgataaaaacccgca

SEQ ID NO: 210413 - DNA, 25 bp, E. coli
gccgggcgtggtactgatcaaagta

SEQ ID NO: 210414 - DNA, 25 bp, E. coli
gccgggcgtggttctgatcaaagta

SEQ ID NO: 210415 - DNA, 25 bp, E. coli
gcgttattggccagacattgctcga

SEQ ID NO: 210416 - DNA, 25 bp, E. coli
gcgttattggcctgacattgctcga

SEQ ID NO: 210417 - DNA, 25 bp, E. coli
cgtggtactgatcaaagtaccgaaa

SEQ ID NO: 210418 - DNA, 25 bp, E. coli
cgtggtactgatgaaagtaccgaaa

SEQ ID NO: 210419 - DNA, 25 bp, E. coli
taatggcgttataggcctgacattg

SEQ ID NO: 210420 - DNA, 25 bp, E. coli
taatggcgttattggcctgacattg

SEQ ID NO: 210421 - DNA, 25 bp, E. coli
caagccgctgccaatatgaacaaga

SEQ ID NO: 210422 - DNA, 25 bp, E. coli
caagccgctgcctatatgaacaaga

SEQ ID NO: 210423 - DNA, 25 bp, E. coli
cagctgatggaaagggtgcagaccc

SEQ ID NO: 210424 - DNA, 25 bp, E. coli
cagctgatggaatgggtgcagaccc

SEQ ID NO: 210425 - DNA, 25 bp, E. coli
cattttatgtcgctggaactgggcg

SEQ ID NO: 210426 - DNA, 25 bp, E. coli
cattttatgtcggtggaactgggcg

SEQ ID NO: 210427 - DNA, 25 bp, E. coli
tactctggctttcggtacagcttcc

SEQ ID NO: 210428 - DNA, 25 bp, E. coli
tactctggctttgggtacagcttcc

SEQ ID NO: 210429 - DNA, 25 bp, E. coli
aaatcgcggcgtaatggttgtcggc

SEQ ID NO: 210430 - DNA, 25 bp, E. coli
aaatcgcggcgttatggttgtcggc

SEQ ID NO: 210431 - DNA, 25 bp, E. coli
tcgagaaagagatcatgcgcgcacc

SEQ ID NO: 210432 - DNA, 25 bp, E. coli
tcgagaaagagaacatgcgcgcacc

SEQ ID NO: 210433 - DNA, 25 bp, E. coli
gaaaactttcgttcactcggcatgg

SEQ ID NO: 210434 - DNA, 25 bp, E. coli
gaaaactttcgtacactcggcatgg

SEQ ID NO: 210435 - DNA, 25 bp, E. coli
gattatggtcgttaaggcagctcct

SEQ ID NO: 210436 - DNA, 25 bp, E. coli
gattatggtcgtaaaggcagctcct

SEQ ID NO: 210437 - DNA, 25 bp, E. coli
ggataaccttaaacgcgcacaaatg

SEQ ID NO: 210438 - DNA, 25 bp, E. coli
ggataaccttaatcgcgcacaaatg

SEQ ID NO: 210439 - DNA, 25 bp, E. coli
tggcgcagccatgttgaccgtaacg

SEQ ID NO: 210440 - DNA, 25 bp, E. coli
tggcgcagccatcttgaccgtaacg

SEQ ID NO: 210441 - DNA, 25 bp, E. coli
gatggaaggctagccgacagatgaa

SEQ ID NO: 210442 - DNA, 25 bp, E. coli
gatggaaggctacccgacagatgaa

SEQ ID NO: 210443 - DNA, 25 bp, E. coli
aattatataactcatggaataggtg

SEQ ID NO: 210444 - DNA, 25 bp, E. coli
aattatataactgatggaataggtg

SEQ ID NO: 210445 - DNA, 25 bp, E. coli
tattttgcgttcgatttgcagggaa

SEQ ID NO: 210446 - DNA, 25 bp, E. coli
tattttgcgttccatttgcagggaa

SEQ ID NO: 210447 - DNA, 25 bp, E. coli
ttgcagggaaagatcacgtaacgct

SEQ ID NO: 210448 - DNA, 25 bp, E. coli
ttgcagggaaagttcacgtaacgct

SEQ ID NO: 210449 - DNA, 25 bp, E. coli
tcccagggaaagttcacgtaacgct

SEQ ID NO: 210450 - DNA, 25 bp, E. coli
tcccagggaaagatcacgtaacgct

SEQ ID NO: 210451 - DNA, 25 bp, E. coli
tcttcctgagaatacaaattaatca

SEQ ID NO: 210452 - DNA, 25 bp, E. coli
tcttcctgagaaaacaaattaatca

SEQ ID NO: 210453 - DNA, 25 bp, E. coli
gccagagttgtaacccagggaaaga

SEQ ID NO: 210454 - DNA, 25 bp, E. coli
gccagagttgtatcccagggaaaga

SEQ ID NO: 210455 - DNA, 25 bp, E. coli
ggaaagtggtgcttaaattgtcaga

SEQ ID NO: 210456 - DNA, 25 bp, E. coli
ggaaagtggtgcataaattgtcaga

SEQ ID NO: 210457 - DNA, 25 bp, E. coli
ggcatcctactaatgactatttttg

SEQ ID NO: 210458 - DNA, 25 bp, E. coli
ggcatcctactattgactatttttg

SEQ ID NO: 210459 - DNA, 25 bp, E. coli
gatcacgtaacggtacttttttgta

SEQ ID NO: 210460 - DNA, 25 bp, E. coli
gatcacgtaacgctacttttttgta

SEQ ID NO: 210461 - DNA, 25 bp, E. coli
gagatactactttttgtctaaagct

SEQ ID NO: 210462 - DNA, 25 bp, E. coli
gagatactacttattgtctaaagct

SEQ ID NO: 210463 - DNA, 25 bp, E. coli
gagcataaattgtcaggcatcctac

SEQ ID NO: 210464 - DNA, 25 bp, E. coli
gagcataaattgacaggcatcctac

SEQ ID NO: 210465 - DNA, 25 bp, E. coli
ttgcagagcggtttgtacgaagtct

SEQ ID NO: 210466 - DNA, 25 bp, E. coli
ttgcagagcggtatgtacgaagtct

SEQ ID NO: 210467 - DNA, 25 bp, E. coli
agcctgcgtggtgctgaatccggaa

SEQ ID NO: 210468 - DNA, 25 bp, E. coli
agcctgcgtggtcctgaatccggaa

SEQ ID NO: 210469 - DNA, 25 bp, E. coli
tgtttacagctagcagccagacttg

SEQ ID NO: 210470 - DNA, 25 bp, E. coli
tgtttacagctaccagccagacttg

SEQ ID NO: 210471 - DNA, 25 bp, E. coli
tgcactcagcagtaatatccggcag

SEQ ID NO: 210472 - DNA, 25 bp, E. coli
tgcactcagcagaaatatccggcag

SEQ ID NO: 210473 - DNA, 25 bp, E. coli
gccagacttgttacaggactgcgga

SEQ ID NO: 210474 - DNA, 25 bp, E. coli
gccagacttgtttcaggactgcgga

SEQ ID NO: 210475 - DNA, 25 bp, E. coli
gaaattctgtgaggcctgtggtacg

SEQ ID NO: 210476 - DNA, 25 bp, E. coli
gaaattctgtgacgcctgtggtacg

SEQ ID NO: 210477 - DNA, 25 bp, E. coli
cgggtgaacacataatcagtgctga

SEQ ID NO: 210478 - DNA, 25 bp, E. coli
ctgagcgagcaacagaaggcagcct

SEQ ID NO: 210479 - DNA, 25 bp, E. coli
cattaccggtcgagctggagtggca

SEQ ID NO: 210480 - DNA, 25 bp, E. coli
cattaccggtcgtgctggagtggca

SEQ ID NO: 210481 - DNA, 25 bp, E. coli
ctgagcgagcaagagaaggcagcct

SEQ ID NO: 210482 - DNA, 25 bp, E. coli
cgggtgaacacaaaatcagtgctga

SEQ ID NO: 210483 - DNA, 25 bp, E. coli
ggaaaagtcccacccttacattgag

SEQ ID NO: 210484 - DNA, 25 bp, E. coli
ggaaaagtcccagccttacattgag

SEQ ID NO: 210485 - DNA, 25 bp, E. coli
gagatgtttttatcgccattaccgg

SEQ ID NO: 210486 - DNA, 25 bp, E. coli
gagatgtttttaacgccattaccgg

SEQ ID NO: 210487 - DNA, 25 bp, E. coli
cacatttgatcgtctgtcggcgtcc

SEQ ID NO: 210488 - DNA, 25 bp, E. coli
cacatttgatcgactgtcggcgtcc

SEQ ID NO: 210489 - DNA, 25 bp, E. coli
tactcttgatgaacgcgagctaaag

SEQ ID NO: 210490 - DNA, 25 bp, E. coli
tacactgcgcaatcactgaaagagt

SEQ ID NO: 210491 - DNA, 25 bp, E. coli
taaaatttatctcgctgaaacgccg

SEQ ID NO: 210492 - DNA, 25 bp, E. coli
tacactgcgcaaacactgaaagagt

SEQ ID NO: 210493 - DNA, 25 bp, E. coli
tactcttgatgatcgcgagctaaag

SEQ ID NO: 210494 - DNA, 25 bp, E. coli
tttacaggctctgtttggcggcacc

SEQ ID NO: 210495 - DNA, 25 bp, E. coli
tttacaggctctctttggcggcacc

SEQ ID NO: 210496 - DNA, 25 bp, E. coli
tccgacctggtacgaatacgaaacg

SEQ ID NO: 210497 - DNA, 25 bp, E. coli
tccgacctggtaggaatacgaaacg

SEQ ID NO: 210498 - DNA, 25 bp, E. coli
cctttgatccggagcactatggtca

SEQ ID NO: 210499 - DNA, 25 bp, E. coli
cctttgatccggtgcactatggtca

SEQ ID NO: 210500 - DNA, 25 bp, E. coli
gcgtaaacacatccttgaactggcg

SEQ ID NO: 210501 - DNA, 25 bp, E. coli
gcgtaaacacatgcttgaactggcg

SEQ ID NO: 210502 - DNA, 25 bp, E. coli
gaagatcttcacgttcagcctgccg

SEQ ID NO: 210503 - DNA, 25 bp, E. coli
gaagatcttcaccttcagcctgccg

SEQ ID NO: 210504 - DNA, 25 bp, E. coli
gaaacgccgtggattaacatctcgg

SEQ ID NO: 210505 - DNA, 25 bp, E. coli
gaaacgccgtggtttaacatctcgg

SEQ ID NO: 210506 - DNA, 25 bp, E. coli
taaaatttatctggctgaaacgccg

SEQ ID NO: 210507 - DNA, 25 bp, E. coli
gatcatttgacagataacccggaag

SEQ ID NO: 210508 - DNA, 25 bp, E. coli
gatcatttgacacataacccggaag

SEQ ID NO: 210509 - DNA, 25 bp, E. coli
tgcaaaacccctgtcgaacgcaatg

SEQ ID NO: 210510 - DNA, 25 bp, E. coli
tgcaaaacccctctcgaacgcaatg

SEQ ID NO: 210511 - DNA, 25 bp, E. coli
gccaacatgggcacggtttaatatc

SEQ ID NO: 210512 - DNA, 25 bp, E. coli
gccaacatgggctcggtttaatatc

SEQ ID NO: 210513 - DNA, 25 bp, E. coli
gcttgtggtgctgtggattatttct

SEQ ID NO: 210514 - DNA, 25 bp, E. coli
gcttgtggtgctctggattatttct

SEQ ID NO: 210515 - DNA, 25 bp, E. coli
gactttaccgtccaggcactttgcc

SEQ ID NO: 210516 - DNA, 25 bp, E. coli
gactttaccgtcgaggcactttgcc

SEQ ID NO: 210517 - DNA, 25 bp, E. coli
gcaacttgcgacaaagactttaccg

SEQ ID NO: 210518 - DNA, 25 bp, E. coli
gaacgcaatggcgagactgctcact

SEQ ID NO: 210519 - DNA, 25 bp, E. coli
gcaacttgcgactaagactttaccg

SEQ ID NO: 210520 - DNA, 25 bp, E. coli
gaacgcaatggccagactgctcact

SEQ ID NO: 210521 - DNA, 25 bp, E. coli
gtcatcaggcgttacaagtgttaaa

SEQ ID NO: 210522 - DNA, 25 bp, E. coli
gattatttctgccaacatgggcacg

SEQ ID NO: 210523 - DNA, 25 bp, E. coli
gattatttctgcgaacatgggcacg

SEQ ID NO: 210524 - DNA, 25 bp, E. coli
gtcatcaggcgtaacaagtgttaaa

SEQ ID NO: 210525 - DNA, 25 bp, E. coli
ggcactttgccctgagtgtcatcag

SEQ ID NO: 210526 - DNA, 25 bp, E. coli
ggcactcaactgtccaacctgcaaa

SEQ ID NO: 210527 - DNA, 25 bp, E. coli
ggcactttgcccagagtgtcatcag

SEQ ID NO: 210528 - DNA, 25 bp, E. coli
ggcactcaactgaccaacctgcaaa

SEQ ID NO: 210529 - DNA, 25 bp, E. coli
gagactgctcactgtgcaacttgcg

SEQ ID NO: 210530 - DNA, 25 bp, E. coli
gagactgctcacagtgcaacttgcg

SEQ ID NO: 210531 - DNA, 25 bp, E. coli
taaacttggtgataaagagcgcacg

SEQ ID NO: 210532 - DNA, 25 bp, E. coli
taaacttggtgaaaaagagcgcacg

SEQ ID NO: 210533 - DNA, 25 bp, E. coli
aaagcactcggtcgtgtcgctaccc

SEQ ID NO: 210534 - DNA, 25 bp, E. coli
aaagcactcggtggtgtcgctaccc

SEQ ID NO: 210535 - DNA, 25 bp, E. coli
tattacgtactatgacggtggtgcg

SEQ ID NO: 210536 - DNA, 25 bp, E. coli
tattacgtactaagacggtggtgcg

SEQ ID NO: 210537 - DNA, 25 bp, E. coli
tgtctatgccgaaatgcgtcacgcc

SEQ ID NO: 210538 - DNA, 25 bp, E. coli
tgtctatgccgatatgcgtcacgcc

SEQ ID NO: 210539 - DNA, 25 bp, E. coli
tgaaggacgtcaattggcctgcggc

SEQ ID NO: 210540 - DNA, 25 bp, E. coli
tgaactccggtgcattacagatggt

SEQ ID NO: 210541 - DNA, 25 bp, E. coli
tgaaaatcagggatcaacaaagccc

SEQ ID NO: 210542 - DNA, 25 bp, E. coli
tgaaaatcagggttcaacaaagccc

SEQ ID NO: 210543 - DNA, 25 bp, E. coli
tgaactccggtggattacagatggt

SEQ ID NO: 210544 - DNA, 25 bp, E. coli
tgaaggacgtcatttggcctgcggc

SEQ ID NO: 210545 - DNA, 25 bp, E. coli
tctacaccgcacatcagcaaggagt

SEQ ID NO: 210546 - DNA, 25 bp, E. coli
tctacaccgcacttcagcaaggagt

SEQ ID NO: 210547 - DNA, 25 bp, E. coli
gaaagcacttcgtcctctgacggca

SEQ ID NO: 210548 - DNA, 25 bp, E. coli
gaaagcacttcgacctctgacggca

SEQ ID NO: 210549 - DNA, 25 bp, E. coli
tcaaggcgaaagatgcacaatcagc

SEQ ID NO: 210550 - DNA, 25 bp, E. coli
tcaaggcgaaagttgcacaatcagc

SEQ ID NO: 210551 - DNA, 25 bp, E. coli
gatgaacacaccatggtacccgatg

SEQ ID NO: 210552 - DNA, 25 bp, E. coli
gatgaacacaccttggtacccgatg

SEQ ID NO: 210553 - DNA, 25 bp, E. coli
caatatgccgcgctatggtcgaaaa

SEQ ID NO: 210554 - DNA, 25 bp, E. coli
caatatgccgcggtatggtcgaaaa

SEQ ID NO: 210555 - DNA, 25 bp, E. coli
aagtggttctatgggctcggctgca

SEQ ID NO: 210556 - DNA, 25 bp, E. coli
caaccggccgtcagtaaaatcatta

SEQ ID NO: 210557 - DNA, 25 bp, E. coli
aagtggttctatcggctcggctgca

SEQ ID NO: 210558 - DNA, 25 bp, E. coli
caaccggccgtctgtaaaatcatta

SEQ ID NO: 210559 - DNA, 25 bp, E. coli
cagcatcggttttggtggaattagc

SEQ ID NO: 210560 - DNA, 25 bp, E. coli
cagcatcggtttaggtggaattagc

SEQ ID NO: 210561 - DNA, 25 bp, E. coli
ttcttccgaaaacgcagcacctggt

SEQ ID NO: 210562 - DNA, 25 bp, E. coli
ttcttccgaaaaggcagcacctggt

SEQ ID NO: 210563 - DNA, 25 bp, E. coli
tgttgagccgctcttcgagtccgag

SEQ ID NO: 210564 - DNA, 25 bp, E. coli
tggtagccagtatgtcccgaacatg

SEQ ID NO: 210565 - DNA, 25 bp, E. coli
tggtagccagtaagtcccgaacatg

SEQ ID NO: 210566 - DNA, 25 bp, E. coli
tgttgagccgctgttcgagtccgag

SEQ ID NO: 210567 - DNA, 25 bp, E. coli
gcaccaccacgctggagtcgttgaa

SEQ ID NO: 210568 - DNA, 25 bp, E. coli
gcaccaccacgcaggagtcgttgaa

SEQ ID NO: 210569 - DNA, 25 bp, E. coli
gataagcggtatctcttctgaggcg

SEQ ID NO: 210570 - DNA, 25 bp, E. coli
gataagcggtatgtcttctgaggcg

SEQ ID NO: 210571 - DNA, 25 bp, E. coli
tcaaagaggtgtacccgaaagcgca

SEQ ID NO: 210572 - DNA, 25 bp, E. coli
tcaaagaggtgttcccgaaagcgca

SEQ ID NO: 210573 - DNA, 25 bp, E. coli
gagtccgagtttctgctggtagcca

SEQ ID NO: 210574 - DNA, 25 bp, E. coli
gagtccgagtttgtgctggtagcca

SEQ ID NO: 210575 - DNA, 25 bp, E. coli
cagcccgtcagctatagcggttggg

SEQ ID NO: 210576 - DNA, 25 bp, E. coli
cagcccgtcagcaatagcggttggg

SEQ ID NO: 210577 - DNA, 25 bp, E. coli
aaaaaatgaagagagcccgtcagct

SEQ ID NO: 210578 - DNA, 25 bp, E. coli
aaaaaatgaagacagcccgtcagct

SEQ ID NO: 210579 - DNA, 25 bp, E. coli
taccctggattgataatgcttacca

SEQ ID NO: 210580 - DNA, 25 bp, E. coli
tatcccttcagttgcgtggccggag

SEQ ID NO: 210581 - DNA, 25 bp, E. coli
tatcccttcagtagcgtggccggag

SEQ ID NO: 210582 - DNA, 25 bp, E. coli
taccctggattgttaatgcttacca

SEQ ID NO: 210583 - DNA, 25 bp, E. coli
tggattgttaatccttaccaccctt

SEQ ID NO: 210584 - DNA, 25 bp, E. coli
tgtaccctttcaacaaatataaacg

SEQ ID NO: 210585 - DNA, 25 bp, E. coli
tgtaccctttcatcaaatataaacg

SEQ ID NO: 210586 - DNA, 25 bp, E. coli
tgaagacagcccctcagctatagcg

SEQ ID NO: 210587 - DNA, 25 bp, E. coli
tgaagacagcccgtcagctatagcg

SEQ ID NO: 210588 - DNA, 25 bp, E. coli
gaatggtatcccttcagttgcgtgg

SEQ ID NO: 210589 - DNA, 25 bp, E. coli
gaatggtatcccatcagttgcgtgg

SEQ ID NO: 210590 - DNA, 25 bp, E. coli
gaacttgattctagtaccctttcat

SEQ ID NO: 210591 - DNA, 25 bp, E. coli
gacagcccgtcagctatagcggttg

SEQ ID NO: 210592 - DNA, 25 bp, E. coli
gaacttgattcttgtaccctttcat

SEQ ID NO: 210593 - DNA, 25 bp, E. coli
gacagcccgtcacctatagcggttg

SEQ ID NO: 210594 - DNA, 25 bp, E. coli
cttcagttgcgtggccggagaaaaa

SEQ ID NO: 210595 - DNA, 25 bp, E. coli
cttcagttgcgtcgccggagaaaaa

SEQ ID NO: 210596 - DNA, 25 bp, E. coli
tggattgttaatgcttaccaccctt

SEQ ID NO: 210597 - DNA, 25 bp, E. coli
caccgaagacccgtgatgaaaagca

SEQ ID NO: 210598 - DNA, 25 bp, E. coli
caccgaagacccctgatgaaaagca

SEQ ID NO: 210599 - DNA, 25 bp, E. coli
tttactccgccggtgagcatctgga

SEQ ID NO: 210600 - DNA, 25 bp, E. coli
tttactccgccgctgagcatctgga

SEQ ID NO: 210601 - DNA, 25 bp, E. coli
tgaaaagcaggatacgccggatatg

SEQ ID NO: 210602 - DNA, 25 bp, E. coli
tgcataaatcgtagagggtcgggct

SEQ ID NO: 210603 - DNA, 25 bp, E. coli
tgcataaatcgttgagggtcgggct

SEQ ID NO: 210604 - DNA, 25 bp, E. coli
tgaaaagcaggaaacgccggatatg

SEQ ID NO: 210605 - DNA, 25 bp, E. coli
gaaaaaggatgataccgggcagacc

SEQ ID NO: 210606 - DNA, 25 bp, E. coli
gaacacttcggtcgctctgatgcag

SEQ ID NO: 210607 - DNA, 25 bp, E. coli
gaacacttcggtggctctgatgcag

SEQ ID NO: 210608 - DNA, 25 bp, E. coli
gaaaaaggatgaaaccgggcagacc

SEQ ID NO: 210609 - DNA, 25 bp, E. coli
cgttaaccagatagagacggtgggc

SEQ ID NO: 210610 - DNA, 25 bp, E. coli
cgttaaccagattgagacggtgggc

SEQ ID NO: 210611 - DNA, 25 bp, E. coli
gattggacttgttcgtgcgctgacc

SEQ ID NO: 210612 - DNA, 25 bp, E. coli
gattggacttgtacgtgcgctgacc

SEQ ID NO: 210613 - DNA, 25 bp, E. coli
ggacatcgaaagcatactcgctacg

SEQ ID NO: 210614 - DNA, 25 bp, E. coli
tcgctacgatcctgaaagaaaacgg

SEQ ID NO: 210615 - DNA, 25 bp, E. coli
ggacatcgaaaggatactcgctacg

SEQ ID NO: 210616 - DNA, 25 bp, E. coli
tcgctacgatccagaaagaaaacgg

SEQ ID NO: 210617 - DNA, 25 bp, E. coli
taactggaactgtgcagcctcgaaa

SEQ ID NO: 210618 - DNA, 25 bp, E. coli
taactggaactgagcagcctcgaaa

SEQ ID NO: 210619 - DNA, 25 bp, E. coli
caactgccagtgttactggttgtgg

SEQ ID NO: 210620 - DNA, 25 bp, E. coli
caactgccagtgatactggttgtgg

SEQ ID NO: 210621 - DNA, 25 bp, E. coli
aaaactgtcgccagctgcgcgcttt

SEQ ID NO: 210622 - DNA, 25 bp, E. coli
aaaactgtcgcctgctgcgcgcttt

SEQ ID NO: 210623 - DNA, 25 bp, E. coli
tgttgactgcgctggcaatactaca

SEQ ID NO: 210624 - DNA, 25 bp, E. coli
tgttgactgcgcaggcaatactaca

SEQ ID NO: 210625 - DNA, 25 bp, E. coli
tgcgcaggcaattctacacgccgga

SEQ ID NO: 210626 - DNA, 25 bp, E. coli
tgcgcaggcaatactacacgccgga

SEQ ID NO: 210627 - DNA, 25 bp, E. coli
gccagctgcgcggttttacaagccg

SEQ ID NO: 210628 - DNA, 25 bp, E. coli
gccagctgcgcgcttttacaagccg

SEQ ID NO: 210629 - DNA, 25 bp, E. coli
gcaggcaatacttcacgccggactg

SEQ ID NO: 210630 - DNA, 25 bp, E. coli
gcaggcaatactacacgccggactg

SEQ ID NO: 210631 - DNA, 25 bp, E. coli
cgctgctgggcgaaattccctggct

SEQ ID NO: 210632 - DNA, 25 bp, E. coli
cgctgctgggcgtaattccctggct

SEQ ID NO: 210633 - DNA, 25 bp, E. coli
gtacatcaatcttgccttaatgtag

SEQ ID NO: 210634 - DNA, 25 bp, E. coli
gatactggttgtcggcgtgaaactc

SEQ ID NO: 210635 - DNA, 25 bp, E. coli
gatactggttgtgggcgtgaaactc

SEQ ID NO: 210636 - DNA, 25 bp, E. coli
gggcgaaattccgtggcttgcagaa

SEQ ID NO: 210637 - DNA, 25 bp, E. coli
gggcgaaattccctggcttgcagaa

SEQ ID NO: 210638 - DNA, 25 bp, E. coli
gtacatcaatctagccttaatgtag

SEQ ID NO: 210639 - DNA, 25 bp, E. coli
ggaaagtacatctatcttgccttaa

SEQ ID NO: 210640 - DNA, 25 bp, E. coli
ggaaagtacatcaatcttgccttaa

SEQ ID NO: 210641 - DNA, 25 bp, E. coli
cagaatcatgccgatcgtctgggca

SEQ ID NO: 210642 - DNA, 25 bp, E. coli
cagaatcatgcccatcgtctgggca

SEQ ID NO: 210643 - DNA, 25 bp, E. coli
agccggacctctttctcgacagcga

SEQ ID NO: 210644 - DNA, 25 bp, E. coli
agccggacctctatctcgacagcga

SEQ ID NO: 210645 - DNA, 25 bp, E. coli
ttccgtttctccacgatgttctgag

SEQ ID NO: 210646 - DNA, 25 bp, E. coli
tattatcagaatcatgccgatcgtc

SEQ ID NO: 210647 - DNA, 25 bp, E. coli
tattatcagaatgatgccgatcgtc

SEQ ID NO: 210648 - DNA, 25 bp, E. coli
ttccgtttctcctcgatgttctgag

SEQ ID NO: 210649 - DNA, 25 bp, E. coli
tgtctatgaacaggatctcacgctg

SEQ ID NO: 210650 - DNA, 25 bp, E. coli
tgtctatgaacacgatctcacgctg

SEQ ID NO: 210651 - DNA, 25 bp, E. coli
gaagatttcgttatctattatcaga

SEQ ID NO: 210652 - DNA, 25 bp, E. coli
gaagatttcgttttctattatcaga

SEQ ID NO: 210653 - DNA, 25 bp, E. coli
gataagctctttacgtcactcttag

SEQ ID NO: 210654 - DNA, 25 bp, E. coli
gatctcacgctgtaagataagctct

SEQ ID NO: 210655 - DNA, 25 bp, E. coli
gatctcacgctgaaagataagctct

SEQ ID NO: 210656 - DNA, 25 bp, E. coli
gatcgtctgggctttgaaggcagca

SEQ ID NO: 210657 - DNA, 25 bp, E. coli
gataagctcttttcgtcactcttag

SEQ ID NO: 210658 - DNA, 25 bp, E. coli
gatcgtctgggcattgaaggcagca

SEQ ID NO: 210659 - DNA, 25 bp, E. coli
gtctgggcattgaaggcagcattcg

SEQ ID NO: 210660 - DNA, 25 bp, E. coli
gtctgggcattgtaggcagcattcg

SEQ ID NO: 210661 - DNA, 25 bp, E. coli
tcaatgagccggtcctctttctcga

SEQ ID NO: 210662 - DNA, 25 bp, E. coli
tcaatgagccggacctctttctcga

SEQ ID NO: 210663 - DNA, 25 bp, E. coli
caaagcgatgaagttgtcggaagat

SEQ ID NO: 210664 - DNA, 25 bp, E. coli
caaagcgatgaacttgtcggaagat

SEQ ID NO: 210665 - DNA, 25 bp, E. coli
tatattctggatccgcgttccgaag

SEQ ID NO: 210666 - DNA, 25 bp, E. coli
tatattctggatgcgcgttccgaag

SEQ ID NO: 210667 - DNA, 25 bp, E. coli
ttaatccgcgttcgaaatatcgacg

SEQ ID NO: 210668 - DNA, 25 bp, E. coli
ttaatccgcgttggaaatatcgacg

SEQ ID NO: 210669 - DNA, 25 bp, E. coli
tgaatatagccgaatcaaagcgatg

SEQ ID NO: 210670 - DNA, 25 bp, E. coli
tgacaatcacggtcctggtactgat

SEQ ID NO: 210671 - DNA, 25 bp, E. coli
tgaatatagccgtatcaaagcgatg

SEQ ID NO: 210672 - DNA, 25 bp, E. coli
tgacaatcacggacctggtactgat

SEQ ID NO: 210673 - DNA, 25 bp, E. coli
tctataacaacgacacgaatcatgg

SEQ ID NO: 210674 - DNA, 25 bp, E. coli
tctacgatcagttcatcatgccccg

SEQ ID NO: 210675 - DNA, 25 bp, E. coli
tctataacaacgtcacgaatcatgg

SEQ ID NO: 210676 - DNA, 25 bp, E. coli
tctacgatcagtacatcatgccccg

SEQ ID NO: 210677 - DNA, 25 bp, E. coli
cggcgtggtcgcttcgatagcgtta

SEQ ID NO: 210678 - DNA, 25 bp, E. coli
cggcgtggtcgcatcgatagcgtta

SEQ ID NO: 210679 - DNA, 25 bp, E. coli
gatagcgttatcatcgtcggattga

SEQ ID NO: 210680 - DNA, 25 bp, E. coli
gatagcgttatcttcgtcggattga

SEQ ID NO: 210681 - DNA, 25 bp, E. coli
ggtactgattctattcatcgccgca

SEQ ID NO: 210682 - DNA, 25 bp, E. coli
ggtactgattcttttcatcgccgca

SEQ ID NO: 210683 - DNA, 25 bp, E. coli
tggcaattcctttgctccggcgtgg

SEQ ID NO: 210684 - DNA, 25 bp, E. coli
tggcaattccttagctccggcgtgg

SEQ ID NO: 210685 - DNA, 25 bp, E. coli
cagaggtgtgtctacaatgaaaaac

SEQ ID NO: 210686 - DNA, 25 bp, E. coli
cagaggtgtgtcaacaatgaaaaac

SEQ ID NO: 210687 - DNA, 25 bp, E. coli
tgtcgacgtcacgaagcttgcaaaa

SEQ ID NO: 210688 - DNA, 25 bp, E. coli
tgatactatcatgaccagaggtgtg

SEQ ID NO: 210689 - DNA, 25 bp, E. coli
tgtcgacgtcaccaagcttgcaaaa

SEQ ID NO: 210690 - DNA, 25 bp, E. coli
tgatactatcatcaccagaggtgtg

SEQ ID NO: 210691 - DNA, 25 bp, E. coli
tcgggcatatcctcggcggcgatgc

SEQ ID NO: 210692 - DNA, 25 bp, E. coli
tctggagacgaggtttatcaagccc

SEQ ID NO: 210693 - DNA, 25 bp, E. coli
tcgggcatatccacggcggcgatgc

SEQ ID NO: 210694 - DNA, 25 bp, E. coli
tctggagacgagctttatcaagccc

SEQ ID NO: 210695 - DNA, 25 bp, E. coli
ccatttacgttgacggagcatgacg

SEQ ID NO: 210696 - DNA, 25 bp, E. coli
ccatttacgttgtcggagcatgacg

SEQ ID NO: 210697 - DNA, 25 bp, E. coli
gctgcaaccggtacgcgcgcataaa

SEQ ID NO: 210698 - DNA, 25 bp, E. coli
gctgcaaccggttcgcgcgcataaa

SEQ ID NO: 210699 - DNA, 25 bp, E. coli
gcggcgatgcatgtaaccgtatttg

SEQ ID NO: 210700 - DNA, 25 bp, E. coli
gcggcgatgcatctaaccgtatttg

SEQ ID NO: 210701 - DNA, 25 bp, E. coli
cgaagcttgcaaaaccgctctacat

SEQ ID NO: 210702 - DNA, 25 bp, E. coli
cgaagcttgcaataccgctctacat

SEQ ID NO: 210703 - DNA, 25 bp, E. coli
cattggcgagccaacgtcgctgcaa

SEQ ID NO: 210704 - DNA, 25 bp, E. coli
cattggcgagcctacgtcgctgcaa

SEQ ID NO: 210705 - DNA, 25 bp, E. coli
tggacgcgcgatccatttacgttga

SEQ ID NO: 210706 - DNA, 25 bp, E. coli
tggacgcgcgatgcatttacgttga

SEQ ID NO: 210707 - DNA, 25 bp, E. coli
cactgcaacaaacgtgatcacaccg

SEQ ID NO: 210708 - DNA, 25 bp, E. coli
cactgcaacaaaggtgatcacaccg

SEQ ID NO: 210709 - DNA, 25 bp, E. coli
taaatttgacgaagaagctgcccat

SEQ ID NO: 210710 - DNA, 25 bp, E. coli
taaatttgacgatgaagctgcccat

SEQ ID NO: 210711 - DNA, 25 bp, E. coli
agagcggtaaggttgccccacatga

SEQ ID NO: 210712 - DNA, 25 bp, E. coli
agagcggtaaggatgccccacatga

SEQ ID NO: 210713 - DNA, 25 bp, E. coli
tgatcacaccggtaacgcgatggag

SEQ ID NO: 210714 - DNA, 25 bp, E. coli
tgatcacaccggaaacgcgatggag

SEQ ID NO: 210715 - DNA, 25 bp, E. coli
gaagagaggctggtacccagaagcc

SEQ ID NO: 210716 - DNA, 25 bp, E. coli
gaagagaggctgctacccagaagcc

SEQ ID NO: 210717 - DNA, 25 bp, E. coli
cccataatcgcggaagcttgctcga

SEQ ID NO: 210718 - DNA, 25 bp, E. coli
cccataatcgcgcaagcttgctcga

SEQ ID NO: 210719 - DNA, 25 bp, E. coli
gtggcgaatacctacgacgacgtga

SEQ ID NO: 210720 - DNA, 25 bp, E. coli
gtggcgaataccaacgacgacgtga

SEQ ID NO: 210721 - DNA, 25 bp, E. coli
tggtacccagaagccacagcaggat

SEQ ID NO: 210722 - DNA, 25 bp, E. coli
tggtacccagaacccacagcaggat

SEQ ID NO: 210723 - DNA, 25 bp, E. coli
ggaagcttgctccaaaccttcaggg

SEQ ID NO: 210724 - DNA, 25 bp, E. coli
ggaagcttgctcgaaaccttcaggg

SEQ ID NO: 210725 - DNA, 25 bp, E. coli
gatggagaatggacgctatcgccgt

SEQ ID NO: 210726 - DNA, 25 bp, E. coli
gatggagaatggtcgctatcgccgt

SEQ ID NO: 210727 - DNA, 25 bp, E. coli
gatgccccacatcataaatttgacg

SEQ ID NO: 210728 - DNA, 25 bp, E. coli
gatgccccacatgataaatttgacg

SEQ ID NO: 210729 - DNA, 25 bp, E. coli
aatttcattaaaaattgttcacccg

SEQ ID NO: 210730 - DNA, 25 bp, E. coli
aatttcattaaatattgttcacccg

SEQ ID NO: 210731 - DNA, 25 bp, E. coli
caggagaaaaccttgagtaaagttg

SEQ ID NO: 210732 - DNA, 25 bp, E. coli
caggagaaaaccatgagtaaagttg

SEQ ID NO: 210733 - DNA, 25 bp, E. coli
agaatggagattccccatcccgcca

SEQ ID NO: 210734 - DNA, 25 bp, E. coli
agtacgttacgtatcactgtgagaa

SEQ ID NO: 210735 - DNA, 25 bp, E. coli
agaatggagattgcccatcccgcca

SEQ ID NO: 210736 - DNA, 25 bp, E. coli
agtacgttacgtttcactgtgagaa

SEQ ID NO: 210737 - DNA, 25 bp, E. coli
tattgttcaccccttttcagtacgt

SEQ ID NO: 210738 - DNA, 25 bp, E. coli
tattgttcacccgttttcagtacgt

SEQ ID NO: 210739 - DNA, 25 bp, E. coli
ttcactgtgagattggagattgccc

SEQ ID NO: 210740 - DNA, 25 bp, E. coli
ttcctgacaggagaaaaccatgagt

SEQ ID NO: 210741 - DNA, 25 bp, E. coli
ttcctgacaggacaaaaccatgagt

SEQ ID NO: 210742 - DNA, 25 bp, E. coli
ttcatccgaacgatcctgacaggag

SEQ ID NO: 210743 - DNA, 25 bp, E. coli
ttcatccgaacgttcctgacaggag

SEQ ID NO: 210744 - DNA, 25 bp, E. coli
ttcactgtgagaatggagattgccc

SEQ ID NO: 210745 - DNA, 25 bp, E. coli
cctggtctaagcatggaaaggatca

SEQ ID NO: 210746 - DNA, 25 bp, E. coli
cctggtctaagcttggaaaggatca

SEQ ID NO: 210747 - DNA, 25 bp, E. coli
gaaaggatcaattttcatccgaacg

SEQ ID NO: 210748 - DNA, 25 bp, E. coli
gaaaggatcaatattcatccgaacg

SEQ ID NO: 210749 - DNA, 25 bp, E. coli
cgccatcctggtctaagcttggaaa

SEQ ID NO: 210750 - DNA, 25 bp, E. coli
cgccatcctggtgtaagcttggaaa

SEQ ID NO: 210751 - DNA, 25 bp, E. coli
caccaggttgactcagtgaagaaaa

SEQ ID NO: 210752 - DNA, 25 bp, E. coli
cagcaccaggttgacacagtgaaga

SEQ ID NO: 210753 - DNA, 25 bp, E. coli
caccaggttgacacagtgaagaaaa

SEQ ID NO: 210754 - DNA, 25 bp, E. coli
cagcaccaggttcacacagtgaaga

SEQ ID NO: 210755 - DNA, 25 bp, E. coli
agcccagcaccacgttgacacagtg

SEQ ID NO: 210756 - DNA, 25 bp, E. coli
agcccagcaccaggttgacacagtg

SEQ ID NO: 210757 - DNA, 25 bp, E. coli
agcaccaggttgacacagtgaagaa

SEQ ID NO: 210758 - DNA, 25 bp, E. coli
agcaccaggttgtcacagtgaagaa

SEQ ID NO: 210759 - DNA, 25 bp, E. coli
ttgacacagtgaagaaaatgtccgt

SEQ ID NO: 210760 - DNA, 25 bp, E. coli
ttgacacagtgatgaaaatgtccgt

SEQ ID NO: 210761 - DNA, 25 bp, E. coli
ccagcaccaggtagacacagtgaag

SEQ ID NO: 210762 - DNA, 25 bp, E. coli
ccaggttgacactgtgaagaaaatg

SEQ ID NO: 210763 - DNA, 25 bp, E. coli
gcccagcaccagcttgacacagtga

SEQ ID NO: 210764 - DNA, 25 bp, E. coli
ccaggttgacacagtgaagaaaatg

SEQ ID NO: 210765 - DNA, 25 bp, E. coli
ccagcaccaggttgacacagtgaag

SEQ ID NO: 210766 - DNA, 25 bp, E. coli
gcccagcaccaggttgacacagtga

SEQ ID NO: 210767 - DNA, 25 bp, E. coli
gcaccaggttgacacagtgaagaaa

SEQ ID NO: 210768 - DNA, 25 bp, E. coli
gcaccaggttgagacagtgaagaaa

SEQ ID NO: 210769 - DNA, 25 bp, E. coli
cccagcaccaggatgacacagtgaa

SEQ ID NO: 210770 - DNA, 25 bp, E. coli
cccagcaccaggttgacacagtgaa

SEQ ID NO: 210771 - DNA, 25 bp, E. coli
ggttgacacagtcaagaaaatgtcc

SEQ ID NO: 210772 - DNA, 25 bp, E. coli
ggttgacacagtgaagaaaatgtcc

SEQ ID NO: 210773 - DNA, 25 bp, E. coli
catctggaaataggtaacggcttgc

SEQ ID NO: 210774 - DNA, 25 bp, E. coli
catctggaaatacgtaacggcttgc

SEQ ID NO: 210775 - DNA, 25 bp, E. coli
cagagaatgcgctacctgggcaaaa

SEQ ID NO: 210776 - DNA, 25 bp, E. coli
cagagaatgcgcaacctgggcaaaa

SEQ ID NO: 210777 - DNA, 25 bp, E. coli
catgaccctgtaagcaatggcagca

SEQ ID NO: 210778 - DNA, 25 bp, E. coli
catgaccctgtatgcaatggcagca

SEQ ID NO: 210779 - DNA, 25 bp, E. coli
aaattgatactcatgcgtgcctgga

SEQ ID NO: 210780 - DNA, 25 bp, E. coli
aaattgccccaaataaatagtgccg

SEQ ID NO: 210781 - DNA, 25 bp, E. coli
aaattgatactcttgcgtgcctgga

SEQ ID NO: 210782 - DNA, 25 bp, E. coli
aaattgccccaattaaatagtgccg

SEQ ID NO: 210783 - DNA, 25 bp, E. coli
tatgtaaaattcaaaagccgcccgg

SEQ ID NO: 210784 - DNA, 25 bp, E. coli
tatgtaaaattctaaagccgcccgg

SEQ ID NO: 210785 - DNA, 25 bp, E. coli
tatattcccggtcagagtgcggcaa

SEQ ID NO: 210786 - DNA, 25 bp, E. coli
tatattcccggtgagagtgcggcaa

SEQ ID NO: 210787 - DNA, 25 bp, E. coli
gaaggcagcattgagcgtttctacc

SEQ ID NO: 210788 - DNA, 25 bp, E. coli
gaaggcagcattcagcgtttctacc

SEQ ID NO: 210789 - DNA, 25 bp, E. coli
ctatcaggatgggtacagaggaaca

SEQ ID NO: 210790 - DNA, 25 bp, E. coli
ctatcaggatggctacagaggaaca

SEQ ID NO: 210791 - DNA, 25 bp, E. coli
gatcagacggtatactttggcacag

SEQ ID NO: 210792 - DNA, 25 bp, E. coli
gattacacttttacgactactggcg

SEQ ID NO: 210793 - DNA, 25 bp, E. coli
gattacactttttcgactactggcg

SEQ ID NO: 210794 - DNA, 25 bp, E. coli
gatcagacggtaaactttggcacag

SEQ ID NO: 210795 - DNA, 25 bp, E. coli
catctggcgatctgcgcggtcttca

SEQ ID NO: 210796 - DNA, 25 bp, E. coli
catctggcgatcagcgcggtcttca

SEQ ID NO: 210797 - DNA, 25 bp, E. coli
tatgtgctgacctcccgcaaagata

SEQ ID NO: 210798 - DNA, 25 bp, E. coli
tatgtgctgaccacccgcaaagata

SEQ ID NO: 210799 - DNA, 25 bp, E. coli
tattttctgctgtgcctgacgctgg

SEQ ID NO: 210800 - DNA, 25 bp, E. coli
tattttctgctgagcctgacgctgg

SEQ ID NO: 210801 - DNA, 25 bp, E. coli
tgtacaacatctacgtcagcctgct

SEQ ID NO: 210802 - DNA, 25 bp, E. coli
tgtacaacatcttcgtcagcctgct

SEQ ID NO: 210803 - DNA, 25 bp, E. coli
tgccagtacggtcctgatgctgcca

SEQ ID NO: 210804 - DNA, 25 bp, E. coli
tgccagtacggtgctgatgctgcca

SEQ ID NO: 210805 - DNA, 25 bp, E. coli
ccagcaacatcattcatggcggtga

SEQ ID NO: 210806 - DNA, 25 bp, E. coli
ccagcaacatcaatcatggcggtga

SEQ ID NO: 210807 - DNA, 25 bp, E. coli
gaatgggtgacgtaatcgctatggc

SEQ ID NO: 210808 - DNA, 25 bp, E. coli
gaatgggtgacgaaatcgctatggc

SEQ ID NO: 210809 - DNA, 25 bp, E. coli
ggcgattaccgctactgccagtacg

SEQ ID NO: 210810 - DNA, 25 bp, E. coli
ggcgattaccgcaactgccagtacg

SEQ ID NO: 210811 - DNA, 25 bp, E. coli
taagccgaccggcattatctccgca

SEQ ID NO: 210812 - DNA, 25 bp, E. coli
taagccgaccgggattatctccgca

SEQ ID NO: 210813 - DNA, 25 bp, E. coli
gatgctgccatctccgggtctgatt

SEQ ID NO: 210814 - DNA, 25 bp, E. coli
gacgctggccttttcggcgattacc

SEQ ID NO: 210815 - DNA, 25 bp, E. coli
gatgctgccatcaccgggtctgatt

SEQ ID NO: 210816 - DNA, 25 bp, E. coli
gacgctggccttatcggcgattacc

SEQ ID NO: 210817 - DNA, 25 bp, E. coli
ctatcgcctgtcatttttattaacg

SEQ ID NO: 210818 - DNA, 25 bp, E. coli
ctatcgcctgtcttttttattaacg

SEQ ID NO: 210819 - DNA, 25 bp, E. coli
aatgtgaatttaatcaggcggatac

SEQ ID NO: 210820 - DNA, 25 bp, E. coli
aatgtgaatttattcaggcggatac

SEQ ID NO: 210821 - DNA, 25 bp, E. coli
tactagcttgacaccgcttttaccc

SEQ ID NO: 210822 - DNA, 25 bp, E. coli
tactagcttgactccgcttttaccc

SEQ ID NO: 210823 - DNA, 25 bp, E. coli
agcttgacaccggttttacccttca

SEQ ID NO: 210824 - DNA, 25 bp, E. coli
agcttgacaccgcttttacccttca

SEQ ID NO: 210825 - DNA, 25 bp, E. coli
aaacgtgtcgtattaatgaatttct

SEQ ID NO: 210826 - DNA, 25 bp, E. coli
aaacgtgtcgtaataatgaatttct

SEQ ID NO: 210827 - DNA, 25 bp, E. coli
tattaacgacaaagactataggtgg

SEQ ID NO: 210828 - DNA, 25 bp, E. coli
tattaacgacaatgactataggtgg

SEQ ID NO: 210829 - DNA, 25 bp, E. coli
gaaaatcttaatcaaacgtgtcgta

SEQ ID NO: 210830 - DNA, 25 bp, E. coli
gactataggtggttacctgaggaaa

SEQ ID NO: 210831 - DNA, 25 bp, E. coli
gaaaatcttaatgaaacgtgtcgta

SEQ ID NO: 210832 - DNA, 25 bp, E. coli
gactataggtggatacctgaggaaa

SEQ ID NO: 210833 - DNA, 25 bp, E. coli
cgcccagcagattaaatgtgaattt

SEQ ID NO: 210834 - DNA, 25 bp, E. coli
cgcccagcagataaaatgtgaattt

SEQ ID NO: 210835 - DNA, 25 bp, E. coli
cgacaatgactaaaggtggttacct

SEQ ID NO: 210836 - DNA, 25 bp, E. coli
cgacaatgactataggtggttacct

SEQ ID NO: 210837 - DNA, 25 bp, E. coli
ggttacctgaggaaaatcttaatga

SEQ ID NO: 210838 - DNA, 25 bp, E. coli
ggttacctgaggtaaatcttaatga

SEQ ID NO: 210839 - DNA, 25 bp, E. coli
cagttcacgggctcattagaaaata

SEQ ID NO: 210840 - DNA, 25 bp, E. coli
cagttcacgggcacattagaaaata

SEQ ID NO: 210841 - DNA, 25 bp, E. coli
taacgcagcatttatgcatagtggt

SEQ ID NO: 210842 - DNA, 25 bp, E. coli
aaaaccagcgttcaccatttgcgta

SEQ ID NO: 210843 - DNA, 25 bp, E. coli
aaaaccagcgttgaccatttgcgta

SEQ ID NO: 210844 - DNA, 25 bp, E. coli
tatttcataaagttctggccactga

SEQ ID NO: 210845 - DNA, 25 bp, E. coli
tatttcataaagatctggccactga

SEQ ID NO: 210846 - DNA, 25 bp, E. coli
ttaggcatcatgtaataacgcagca

SEQ ID NO: 210847 - DNA, 25 bp, E. coli
ttaggcatcatgaaataacgcagca

SEQ ID NO: 210848 - DNA, 25 bp, E. coli
tgcaacgtaccgcataaaaccagcg

SEQ ID NO: 210849 - DNA, 25 bp, E. coli
tgcaacgtaccggataaaaccagcg

SEQ ID NO: 210850 - DNA, 25 bp, E. coli
tccaccttatattaagcatggaggg

SEQ ID NO: 210851 - DNA, 25 bp, E. coli
tccaccttatataaagcatggaggg

SEQ ID NO: 210852 - DNA, 25 bp, E. coli
tggccactgagtgagttttcaatca

SEQ ID NO: 210853 - DNA, 25 bp, E. coli
tggccactgagtcagttttcaatca

SEQ ID NO: 210854 - DNA, 25 bp, E. coli
taacgctggtttttcttaggcatca

SEQ ID NO: 210855 - DNA, 25 bp, E. coli
taacgctggtttatcttaggcatca

SEQ ID NO: 210856 - DNA, 25 bp, E. coli
taagcatggaggctttcagttcacg

SEQ ID NO: 210857 - DNA, 25 bp, E. coli
taacgcagcattaatgcatagtggt

SEQ ID NO: 210858 - DNA, 25 bp, E. coli
taagcatggagggtttcagttcacg

SEQ ID NO: 210859 - DNA, 25 bp, E. coli
gagttttcaatctcctttccatcca

SEQ ID NO: 210860 - DNA, 25 bp, E. coli
gagttttcaatcacctttccatcca

SEQ ID NO: 210861 - DNA, 25 bp, E. coli
aacggcctgccaagtgacaaatctg

SEQ ID NO: 210862 - DNA, 25 bp, E. coli
tacggttttctgtttacaggataag

SEQ ID NO: 210863 - DNA, 25 bp, E. coli
acggcaacggcctgccatgtgacaa

SEQ ID NO: 210864 - DNA, 25 bp, E. coli
aacggcctgccatgtgacaaatctg

SEQ ID NO: 210865 - DNA, 25 bp, E. coli
acggcaacggccagccatgtgacaa

SEQ ID NO: 210866 - DNA, 25 bp, E. coli
tacggttttctgattacaggataag

SEQ ID NO: 210867 - DNA, 25 bp, E. coli
ttacaggataagtgcgcacggcaac

SEQ ID NO: 210868 - DNA, 25 bp, E. coli
ttacaggataagagcgcacggcaac

SEQ ID NO: 210869 - DNA, 25 bp, E. coli
tgtttacaggattagagcgcacggc

SEQ ID NO: 210870 - DNA, 25 bp, E. coli
tgtgacaaatctcccaaaagctgga

SEQ ID NO: 210871 - DNA, 25 bp, E. coli
tgtttacaggataagagcgcacggc

SEQ ID NO: 210872 - DNA, 25 bp, E. coli
tgtgacaaatctgccaaaagctgga

SEQ ID NO: 210873 - DNA, 25 bp, E. coli
gccaaaagctggacaaatgtaatgt

SEQ ID NO: 210874 - DNA, 25 bp, E. coli
gccaaaagctggtcaaatgtaatgt

SEQ ID NO: 210875 - DNA, 25 bp, E. coli
gcctgccatgtgacaaatctgccaa

SEQ ID NO: 210876 - DNA, 25 bp, E. coli
gcctgccatgtgtcaaatctgccaa

SEQ ID NO: 210877 - DNA, 25 bp, E. coli
gacaaatctgccaaaagctggacaa

SEQ ID NO: 210878 - DNA, 25 bp, E. coli
gacaaatctgcctaaagctggacaa

SEQ ID NO: 210879 - DNA, 25 bp, E. coli
cattgcctctctgccggtacggttt

SEQ ID NO: 210880 - DNA, 25 bp, E. coli
cattgcctctctcccggtacggttt

SEQ ID NO: 210881 - DNA, 25 bp, E. coli
ggataagagcgcacggcaacggcct

SEQ ID NO: 210882 - DNA, 25 bp, E. coli
ggataagagcgctcggcaacggcct

SEQ ID NO: 210883 - DNA, 25 bp, E. coli
cacgccgccggtaggcaacgtgcag

SEQ ID NO: 210884 - DNA, 25 bp, E. coli
cacgccgccggttggcaacgtgcag

SEQ ID NO: 210885 - DNA, 25 bp, E. coli
tactggaacgcagtaagcgctaccc

SEQ ID NO: 210886 - DNA, 25 bp, E. coli
tactggaacgcactaagcgctaccc

SEQ ID NO: 210887 - DNA, 25 bp, E. coli
taagcgctaccctcaacgttttgca

SEQ ID NO: 210888 - DNA, 25 bp, E. coli
cagggaaccggtcaaattgaaatca

SEQ ID NO: 210889 - DNA, 25 bp, E. coli
cagggaaccggtgaaattgaaatca

SEQ ID NO: 210890 - DNA, 25 bp, E. coli
taagcgctacccacaacgttttgca

SEQ ID NO: 210891 - DNA, 25 bp, E. coli
ttattcgactccctgaacagcgcgc

SEQ ID NO: 210892 - DNA, 25 bp, E. coli
ttattcgactccgtgaacagcgcgc

SEQ ID NO: 210893 - DNA, 25 bp, E. coli
tgaaatcaccattcagaccaacggc

SEQ ID NO: 210894 - DNA, 25 bp, E. coli
tgaaatcaccatacagaccaacggc

SEQ ID NO: 210895 - DNA, 25 bp, E. coli
tctgaccgaacttgccggtgcggta

SEQ ID NO: 210896 - DNA, 25 bp, E. coli
tctgaccgaactagccggtgcggta

SEQ ID NO: 210897 - DNA, 25 bp, E. coli
gcaacgtgcagggaaccggtgaaat

SEQ ID NO: 210898 - DNA, 25 bp, E. coli
gcaatcctgcggaaacaaaatgaat

SEQ ID NO: 210899 - DNA, 25 bp, E. coli
gcaacgtgcaggcaaccggtgaaat

SEQ ID NO: 210900 - DNA, 25 bp, E. coli
gcaatcctgcggtaacaaaatgaat

SEQ ID NO: 210901 - DNA, 25 bp, E. coli
ccggtgcggtacaggaacgcagtaa

SEQ ID NO: 210902 - DNA, 25 bp, E. coli
ccggtgcggtactggaacgcagtaa

SEQ ID NO: 210903 - DNA, 25 bp, E. coli
gttttgcactgaaaaccacgccgcc

SEQ ID NO: 210904 - DNA, 25 bp, E. coli
gttttgcactgataaccacgccgcc

SEQ ID NO: 210905 - DNA, 25 bp, E. coli
cagcaccgccgaatgctgtggcgaa

SEQ ID NO: 210906 - DNA, 25 bp, E. coli
cagcaccgccgattgctgtggcgaa

SEQ ID NO: 210907 - DNA, 25 bp, E. coli
tactattctgcaagcccggaaacgc

SEQ ID NO: 210908 - DNA, 25 bp, E. coli
tactattctgcatgcccggaaacgc

SEQ ID NO: 210909 - DNA, 25 bp, E. coli
cctaccttgtccaggcaaccattgg

SEQ ID NO: 210910 - DNA, 25 bp, E. coli
cctaccttgtcctggcaaccattgg

SEQ ID NO: 210911 - DNA, 25 bp, E. coli
ttgccagtgatgttgcgtattaccc

SEQ ID NO: 210912 - DNA, 25 bp, E. coli
ttgccagtgatgatgcgtattaccc

SEQ ID NO: 210913 - DNA, 25 bp, E. coli
tgtcctggcaaccattggcttacta

SEQ ID NO: 210914 - DNA, 25 bp, E. coli
tgtcctggcaacgattggcttacta

SEQ ID NO: 210915 - DNA, 25 bp, E. coli
tgcgtattacccaaccttgtcctgg

SEQ ID NO: 210916 - DNA, 25 bp, E. coli
tgatgatgcgtaataccctaccttg

SEQ ID NO: 210917 - DNA, 25 bp, E. coli
tgcgtattaccctaccttgtcctgg

SEQ ID NO: 210918 - DNA, 25 bp, E. coli
tgatgatgcgtattaccctaccttg

SEQ ID NO: 210919 - DNA, 25 bp, E. coli
gccagtgatgatgcgtattacccta

SEQ ID NO: 210920 - DNA, 25 bp, E. coli
gccagtgatgatccgtattacccta

SEQ ID NO: 210921 - DNA, 25 bp, E. coli
gtattaccctaccttgtcctggcaa

SEQ ID NO: 210922 - DNA, 25 bp, E. coli
gtattaccctacgttgtcctggcaa

SEQ ID NO: 210923 - DNA, 25 bp, E. coli
ggcaaccattggcttactattctgc

SEQ ID NO: 210924 - DNA, 25 bp, E. coli
ggcttactattcagcatgcccggaa

SEQ ID NO: 210925 - DNA, 25 bp, E. coli
ggcttactattctgcatgcccggaa

SEQ ID NO: 210926 - DNA, 25 bp, E. coli
ggcaaccattgggttactattctgc

SEQ ID NO: 210927 - DNA, 25 bp, E. coli
caaagcgcggctcgaaaaaatggcg

SEQ ID NO: 210928 - DNA, 25 bp, E. coli
caaagcgcggctggaaaaaatggcg

SEQ ID NO: 210929 - DNA, 25 bp, E. coli
cagatgccgtattgccgtcgaaact

SEQ ID NO: 210930 - DNA, 25 bp, E. coli
cagatgccgtatagccgtcgaaact

SEQ ID NO: 210931 - DNA, 25 bp, E. coli
tgaatatgccgatcgcacgctcgat

SEQ ID NO: 210932 - DNA, 25 bp, E. coli
tgctgcccaaactcaacacggtggc

SEQ ID NO: 210933 - DNA, 25 bp, E. coli
tgatggcgcaacgtcgctggaagcc

SEQ ID NO: 210934 - DNA, 25 bp, E. coli
tgaatatgccgaacgcacgctcgat

SEQ ID NO: 210935 - DNA, 25 bp, E. coli
tgatggcgcaacctcgctggaagcc

SEQ ID NO: 210936 - DNA, 25 bp, E. coli
tgctgcccaaacacaacacggtggc

SEQ ID NO: 210937 - DNA, 25 bp, E. coli
tgcgaaacctttccgggcattgcgg

SEQ ID NO: 210938 - DNA, 25 bp, E. coli
tgcgaaacctttgcgggcattgcgg

SEQ ID NO: 210939 - DNA, 25 bp, E. coli
ccatctggtggtccaaaaacgcggc

SEQ ID NO: 210940 - DNA, 25 bp, E. coli
ccatctggtggtgcaaaaacgcggc

SEQ ID NO: 210941 - DNA, 25 bp, E. coli
gcaatcgtatgacgctttacccgca

SEQ ID NO: 210942 - DNA, 25 bp, E. coli
gcaatcgtatgaggctttacccgca

SEQ ID NO: 210943 - DNA, 25 bp, E. coli
cgttcgaacgtaccggactgcataa

SEQ ID NO: 210944 - DNA, 25 bp, E. coli
cgttcgaacgtagcggactgcataa

SEQ ID NO: 210945 - DNA, 25 bp, E. coli
gttgatgcccttcgtaaccagcttg

SEQ ID NO: 210946 - DNA, 25 bp, E. coli
gttgatgcccttggtaaccagcttg

SEQ ID NO: 210947 - DNA, 25 bp, E. coli
gtggcggcggaaaacgtcatcttct

SEQ ID NO: 210948 - DNA, 25 bp, E. coli
gtggcggcggaatacgtcatcttct

SEQ ID NO: 210949 - DNA, 25 bp, E. coli
aatttacggcgatgctcaacccgga

SEQ ID NO: 210950 - DNA, 25 bp, E. coli
aatttacggcgaagctcaacccgga

SEQ ID NO: 210951 - DNA, 25 bp, E. coli
tacgcgcgtcattactcagtggaaa

SEQ ID NO: 210952 - DNA, 25 bp, E. coli
agcgggtgatcaaagcaaagcgtcc

SEQ ID NO: 210953 - DNA, 25 bp, E. coli
agcgggtgatcatagcaaagcgtcc

SEQ ID NO: 210954 - DNA, 25 bp, E. coli
tacgcgcgtcataactcagtggaaa

SEQ ID NO: 210955 - DNA, 25 bp, E. coli
tatttgcaagcctctccggtactga

SEQ ID NO: 210956 - DNA, 25 bp, E. coli
tatttgcaagccactccggtactga

SEQ ID NO: 210957 - DNA, 25 bp, E. coli
tgtaattattgcattcggcccagct

SEQ ID NO: 210958 - DNA, 25 bp, E. coli
tgtaattattgctttcggcccagct

SEQ ID NO: 210959 - DNA, 25 bp, E. coli
tccgcttaaaaaatgtgacgcctgg

SEQ ID NO: 210960 - DNA, 25 bp, E. coli
tccgcttaaaaattgtgacgcctgg

SEQ ID NO: 210961 - DNA, 25 bp, E. coli
gcggatttcgcgttaagcaggctga

SEQ ID NO: 210962 - DNA, 25 bp, E. coli
gcggatttcgcgataagcaggctga

SEQ ID NO: 210963 - DNA, 25 bp, E. coli
ggtactgatccaatcactggcgtgg

SEQ ID NO: 210964 - DNA, 25 bp, E. coli
ggtactgatccattcactggcgtgg

SEQ ID NO: 210965 - DNA, 25 bp, E. coli
ggctgaactgaaactctacgcgcgt

SEQ ID NO: 210966 - DNA, 25 bp, E. coli
ggctgaactgaatctctacgcgcgt

SEQ ID NO: 210967 - DNA, 25 bp, E. coli
tcaaccctttactcgcgatcagcgg

SEQ ID NO: 210968 - DNA, 25 bp, E. coli
taacgtccagcattgtatggccggg

SEQ ID NO: 210969 - DNA, 25 bp, E. coli
taacgtccagcaatgtatggccggg

SEQ ID NO: 210970 - DNA, 25 bp, E. coli
tcaaccctttacacgcgatcagcgg

SEQ ID NO: 210971 - DNA, 25 bp, E. coli
caaagcgttgatgttgacgaatggg

SEQ ID NO: 210972 - DNA, 25 bp, E. coli
caaagcgttgatcttgacgaatggg

SEQ ID NO: 210973 - DNA, 25 bp, E. coli
tgatcttgacgattgggtgaaagat

SEQ ID NO: 210974 - DNA, 25 bp, E. coli
tgatcttgacgaatgggtgaaagat

SEQ ID NO: 210975 - DNA, 25 bp, E. coli
tggtggagtatgtccagcaaagcgt

SEQ ID NO: 210976 - DNA, 25 bp, E. coli
tggtggagtatgaccagcaaagcgt

SEQ ID NO: 210977 - DNA, 25 bp, E. coli
tcaatgacgttaacctctggttcca

SEQ ID NO: 210978 - DNA, 25 bp, E. coli
tcaatgacgttatcctctggttcca

SEQ ID NO: 210979 - DNA, 25 bp, E. coli
tctggttccactggcttgccgaaag

SEQ ID NO: 210980 - DNA, 25 bp, E. coli
tcatcggccggttgcggtggtggag

SEQ ID NO: 210981 - DNA, 25 bp, E. coli
tcatcggccggtagcggtggtggag

SEQ ID NO: 210982 - DNA, 25 bp, E. coli
tctggttccactcgcttgccgaaag

SEQ ID NO: 210983 - DNA, 25 bp, E. coli
gttccactggcttgccgaaagccgc

SEQ ID NO: 210984 - DNA, 25 bp, E. coli
gttccactggctagccgaaagccgc

SEQ ID NO: 210985 - DNA, 25 bp, E. coli
ggcgtaatgggctacgggttccact

SEQ ID NO: 210986 - DNA, 25 bp, E. coli
tgggcaacgggtaccactggttaat

SEQ ID NO: 210987 - DNA, 25 bp, E. coli
tgggcaacgggttccactggttaat

SEQ ID NO: 210988 - DNA, 25 bp, E. coli
ggcgtaatgggcaacgggttccact

SEQ ID NO: 210989 - DNA, 25 bp, E. coli
taacctctggttccactggcttgcc

SEQ ID NO: 210990 - DNA, 25 bp, E. coli
taacctctggttgcactggcttgcc

SEQ ID NO: 210991 - DNA, 25 bp, E. coli
gaccagcaaagccttgatcttgacg

SEQ ID NO: 210992 - DNA, 25 bp, E. coli
gaccagcaaagcgttgatcttgacg

SEQ ID NO: 210993 - DNA, 25 bp, E. coli
cacaccgcgtattttgatcgtggaa

SEQ ID NO: 210994 - DNA, 25 bp, E. coli
cacaccgcgtatattgatcgtggaa

SEQ ID NO: 210995 - DNA, 25 bp, E. coli
caggaaaagtgtactcccgcgagca

SEQ ID NO: 210996 - DNA, 25 bp, E. coli
caggaaaagtgttctcccgcgagca

SEQ ID NO: 210997 - DNA, 25 bp, E. coli
tacagcccacggcaagtggtagcgc

SEQ ID NO: 210998 - DNA, 25 bp, E. coli
tacagcccacgggaagtggtagcgc

SEQ ID NO: 210999 - DNA, 25 bp, E. coli
taccaatcgacgaaaacacaccgcg

SEQ ID NO: 211000 - DNA, 25 bp, E. coli
taccaatcgacgtaaacacaccgcg

SEQ ID NO: 211001 - DNA, 25 bp, E. coli
ttttgcgccgttccaaaccgcagcg

SEQ ID NO: 211002 - DNA, 25 bp, E. coli
ttttgcgccgttgcaaaccgcagcg

SEQ ID NO: 211003 - DNA, 25 bp, E. coli
ttcgtctgctgataacgctctctca

SEQ ID NO: 211004 - DNA, 25 bp, E. coli
ttcgtctgctgaaaacgctctctca

SEQ ID NO: 211005 - DNA, 25 bp, E. coli
tgaaagcccgttcattatcgacgaa

SEQ ID NO: 211006 - DNA, 25 bp, E. coli
tgaaagcccgttgattatcgacgaa

SEQ ID NO: 211007 - DNA, 25 bp, E. coli
gaacagtcatttatccgcgccgttt

SEQ ID NO: 211008 - DNA, 25 bp, E. coli
gaacagtcatttttccgcgccgttt

SEQ ID NO: 211009 - DNA, 25 bp, E. coli
cattgattatctgcgtgctgcgagc

SEQ ID NO: 211010 - DNA, 25 bp, E. coli
cattgattatctccgtgctgcgagc

SEQ ID NO: 211011 - DNA, 25 bp, E. coli
ggtaaaatgcttgacctgacgcctg

SEQ ID NO: 211012 - DNA, 25 bp, E. coli
ggtaaaatgcttcacctgacgcctg

SEQ ID NO: 211013 - DNA, 25 bp, E. coli
tggaatctctcgtcgccgaacagtc

SEQ ID NO: 211014 - DNA, 25 bp, E. coli
tggaatctctcgacgccgaacagtc

SEQ ID NO: 211015 - DNA, 25 bp, E. coli
taaaaatggcgcaaatacagcgcca

SEQ ID NO: 211016 - DNA, 25 bp, E. coli
taaaaatggcgctaatacagcgcca

SEQ ID NO: 211017 - DNA, 25 bp, E. coli
aacgaagccccgctattatcgctgg

SEQ ID NO: 211018 - DNA, 25 bp, E. coli
aacgaagccccggtattatcgctgg

SEQ ID NO: 211019 - DNA, 25 bp, E. coli
tatcgcgctacttcaggatgatgta

SEQ ID NO: 211020 - DNA, 25 bp, E. coli
tatcgcgctactacaggatgatgta

SEQ ID NO: 211021 - DNA, 25 bp, E. coli
tatattctgatgcagatagtcagtg

SEQ ID NO: 211022 - DNA, 25 bp, E. coli
tatattctgatggagatagtcagtg

SEQ ID NO: 211023 - DNA, 25 bp, E. coli
tgctggcaaatagaagaagtatcgg

SEQ ID NO: 211024 - DNA, 25 bp, E. coli
tgctggcaaatacaagaagtatcgg

SEQ ID NO: 211025 - DNA, 25 bp, E. coli
gcattgaatgattaaaatggcgcaa

SEQ ID NO: 211026 - DNA, 25 bp, E. coli
gcattgaatgataaaaatggcgcaa

SEQ ID NO: 211027 - DNA, 25 bp, E. coli
gaagagaggcattgttgctggcaaa

SEQ ID NO: 211028 - DNA, 25 bp, E. coli
gaagagaggcatagttgctggcaaa

SEQ ID NO: 211029 - DNA, 25 bp, E. coli
cgaagaacgctagagaagagaggca

SEQ ID NO: 211030 - DNA, 25 bp, E. coli
cgaagaacgctacagaagagaggca

SEQ ID NO: 211031 - DNA, 25 bp, E. coli
gatagtcagtgagtatatcgcgcta

SEQ ID NO: 211032 - DNA, 25 bp, E. coli
gatagtcagtgactatatcgcgcta

SEQ ID NO: 211033 - DNA, 25 bp, E. coli
tacagcgccatttttataggttaaa

SEQ ID NO: 211034 - DNA, 25 bp, E. coli
tacagcgccattattataggttaaa

SEQ ID NO: 211035 - DNA, 25 bp, E. coli
gatgatgtagatccgaagaacgcta

SEQ ID NO: 211036 - DNA, 25 bp, E. coli
gatgatgtagatgcgaagaacgcta

SEQ ID NO: 211037 - DNA, 25 bp, E. coli
caagcagggcgtggatctgaacagc

SEQ ID NO: 211038 - DNA, 25 bp, E. coli
caacctggcgatcaaaggtgcagcc

SEQ ID NO: 211039 - DNA, 25 bp, E. coli
caagcagggcgtcgatctgaacagc

SEQ ID NO: 211040 - DNA, 25 bp, E. coli
caacctggcgatgaaaggtgcagcc

SEQ ID NO: 211041 - DNA, 25 bp, E. coli
tactgaagaagacatcgactacacc

SEQ ID NO: 211042 - DNA, 25 bp, E. coli
taaatccatcggacgtctgcgtgac

SEQ ID NO: 211043 - DNA, 25 bp, E. coli
tactgaagaagagatcgactacacc

SEQ ID NO: 211044 - DNA, 25 bp, E. coli
taaatccatcggtcgtctgcgtgac

SEQ ID NO: 211045 - DNA, 25 bp, E. coli
tatgacgatggagggaacctttggt

SEQ ID NO: 211046 - DNA, 25 bp, E. coli
tatgacgatggacggaacctttggt

SEQ ID NO: 211047 - DNA, 25 bp, E. coli
tatcacgttgatgcaacccagagcg

SEQ ID NO: 211048 - DNA, 25 bp, E. coli
tatcacgttgatccaacccagagcg

SEQ ID NO: 211049 - DNA, 25 bp, E. coli
tgaacggtgaccaggaacacggtgc

SEQ ID NO: 211050 - DNA, 25 bp, E. coli
tgaacggtgacctggaacacggtgc

SEQ ID NO: 211051 - DNA, 25 bp, E. coli
gcgtgacctttctccgctgtgggaa

SEQ ID NO: 211052 - DNA, 25 bp, E. coli
gcgtgacctttcaccgctgtgggaa

SEQ ID NO: 211053 - DNA, 25 bp, E. coli
gatatcgcccgtaatcagattgccg

SEQ ID NO: 211054 - DNA, 25 bp, E. coli
gatatcgcccgttatcagattgccg

SEQ ID NO: 211055 - DNA, 25 bp, E. coli
tcaccgtttcgggtggcaggctgaa

SEQ ID NO: 211056 - DNA, 25 bp, E. coli
tcaccgtttcggctggcaggctgaa

SEQ ID NO: 211057 - DNA, 25 bp, E. coli
gacccgcgtgttgccgagaaaatga

SEQ ID NO: 211058 - DNA, 25 bp, E. coli
gacccgcgtgttcccgagaaaatga

SEQ ID NO: 211059 - DNA, 25 bp, E. coli
caatgttcttgacggttttaatgac

SEQ ID NO: 211060 - DNA, 25 bp, E. coli
caatgttcttgagggttttaatgac

SEQ ID NO: 211061 - DNA, 25 bp, E. coli
caaagcccactttagttacagaaca

SEQ ID NO: 211062 - DNA, 25 bp, E. coli
caaagcccacttaagttacagaaca

SEQ ID NO: 211063 - DNA, 25 bp, E. coli
tacagaacacaatgttcttgagggt

SEQ ID NO: 211064 - DNA, 25 bp, E. coli
tacagaacacaaagttcttgagggt

SEQ ID NO: 211065 - DNA, 25 bp, E. coli
gggttttaatgacatattttcacga

SEQ ID NO: 211066 - DNA, 25 bp, E. coli
gggttttaatgagatattttcacga

SEQ ID NO: 211067 - DNA, 25 bp, E. coli
tagcaaatataccattgcctgatgc

SEQ ID NO: 211068 - DNA, 25 bp, E. coli
tagtcctacaaatcatcaatatatt

SEQ ID NO: 211069 - DNA, 25 bp, E. coli
tagcaaatatacgattgcctgatgc

SEQ ID NO: 211070 - DNA, 25 bp, E. coli
tagtcctacaaaacatcaatatatt

SEQ ID NO: 211071 - DNA, 25 bp, E. coli
ttgtagaccagaaaaggcattcacg

SEQ ID NO: 211072 - DNA, 25 bp, E. coli
ttgtagaccagataaggcattcacg

SEQ ID NO: 211073 - DNA, 25 bp, E. coli
tgcgctccgcttattagtcctacaa

SEQ ID NO: 211074 - DNA, 25 bp, E. coli
tcgaaactgttagcaaatataccat

SEQ ID NO: 211075 - DNA, 25 bp, E. coli
tccggcaggaactaagcccacttta

SEQ ID NO: 211076 - DNA, 25 bp, E. coli
tgcgctccgctttttagtcctacaa

SEQ ID NO: 211077 - DNA, 25 bp, E. coli
tccggcaggaacaaagcccacttta

SEQ ID NO: 211078 - DNA, 25 bp, E. coli
tcgaaactgttaccaaatataccat

SEQ ID NO: 211079 - DNA, 25 bp, E. coli
gaatttaggcaacatttgtagacca

SEQ ID NO: 211080 - DNA, 25 bp, E. coli
gaatttaggcaagatttgtagacca

SEQ ID NO: 211081 - DNA, 25 bp, E. coli
aacctacaggctatcttctcagatg

SEQ ID NO: 211082 - DNA, 25 bp, E. coli
aacctacaggctttcttctcagatg

SEQ ID NO: 211083 - DNA, 25 bp, E. coli
agacttgatcttcatctggcaaggg

SEQ ID NO: 211084 - DNA, 25 bp, E. coli
agacttgatcttgatctggcaaggg

SEQ ID NO: 211085 - DNA, 25 bp, E. coli
tagggttgatatctccggcttcccc

SEQ ID NO: 211086 - DNA, 25 bp, E. coli
tagggttgatatgtccggcttcccc

SEQ ID NO: 211087 - DNA, 25 bp, E. coli
tttcaagaaaggtcgtcacaccacg

SEQ ID NO: 211088 - DNA, 25 bp, E. coli
tttcaagaaaggacgtcacaccacg

SEQ ID NO: 211089 - DNA, 25 bp, E. coli
tttacatcttaaagaacaagttatg

SEQ ID NO: 211090 - DNA, 25 bp, E. coli
tttacatcttaatgaacaagttatg

SEQ ID NO: 211091 - DNA, 25 bp, E. coli
gcgcataatgcatctttcaagaaag

SEQ ID NO: 211092 - DNA, 25 bp, E. coli
gctatcttctcagatggccttaggg

SEQ ID NO: 211093 - DNA, 25 bp, E. coli
gcgcataatgcaactttcaagaaag

SEQ ID NO: 211094 - DNA, 25 bp, E. coli
gctatcttctcacatggccttaggg

SEQ ID NO: 211095 - DNA, 25 bp, E. coli
gaaaggtcgtcacaccacgaggaag

SEQ ID NO: 211096 - DNA, 25 bp, E. coli
gaaaggtcgtcagaccacgaggaag

SEQ ID NO: 211097 - DNA, 25 bp, E. coli
gggaaccgagcatacctacaggcta

SEQ ID NO: 211098 - DNA, 25 bp, E. coli
gggaaccgagcaaacctacaggcta

SEQ ID NO: 211099 - DNA, 25 bp, E. coli
tcacaccacgagcaagacttgatct

SEQ ID NO: 211100 - DNA, 25 bp, E. coli
tcacaccacgaggaagacttgatct

SEQ ID NO: 211101 - DNA, 25 bp, E. coli
gatggccttaggcttgatatgtccg

SEQ ID NO: 211102 - DNA, 25 bp, E. coli
gatggccttagggttgatatgtccg

SEQ ID NO: 211103 - DNA, 25 bp, E. coli
caagaggtgatggttaacggcaagc

SEQ ID NO: 211104 - DNA, 25 bp, E. coli
caattgctcgaacatctggaggcga

SEQ ID NO: 211105 - DNA, 25 bp, E. coli
caagcctttgaaggctgggagtatc

SEQ ID NO: 211106 - DNA, 25 bp, E. coli
caattgctcgaagatctggaggcga

SEQ ID NO: 211107 - DNA, 25 bp, E. coli
caagaggtgatgcttaacggcaagc

SEQ ID NO: 211108 - DNA, 25 bp, E. coli
caagcctttgaacgctgggagtatc

SEQ ID NO: 211109 - DNA, 25 bp, E. coli
taaagcggcatttggacgcgcgctg

SEQ ID NO: 211110 - DNA, 25 bp, E. coli
taaagcggcattaggacgcgcgctg

SEQ ID NO: 211111 - DNA, 25 bp, E. coli
tatttcgcgcctggtgatgaacgac

SEQ ID NO: 211112 - DNA, 25 bp, E. coli
tatttcgcgcctcgtgatgaacgac

SEQ ID NO: 211113 - DNA, 25 bp, E. coli
tttatccgcaatatggcgacgcgca

SEQ ID NO: 211114 - DNA, 25 bp, E. coli
tttatccgcaatttggcgacgcgca

SEQ ID NO: 211115 - DNA, 25 bp, E. coli
gacagcgggcgttttcacgttggca

SEQ ID NO: 211116 - DNA, 25 bp, E. coli
gacagcgggcgtattcacgttggca

SEQ ID NO: 211117 - DNA, 25 bp, E. coli
cgttggcaccaatctggaagtggct

SEQ ID NO: 211118 - DNA, 25 bp, E. coli
cgttggcaccaaactggaagtggct

SEQ ID NO: 211119 - DNA, 25 bp, E. coli
ctgtggcagctggaaaaccgcatca

SEQ ID NO: 211120 - DNA, 25 bp, E. coli
ctgtggcagctgcaaaaccgcatca

SEQ ID NO: 211121 - DNA, 25 bp, E. coli
gtatgtggcgctgaaacagcctgcg

SEQ ID NO: 211122 - DNA, 25 bp, E. coli
gtatgtggcgctcaaacagcctgcg

SEQ ID NO: 211123 - DNA, 25 bp, E. coli
tggaaaaagaagtagccctgcgcgt

SEQ ID NO: 211124 - DNA, 25 bp, E. coli
tggaaaaagaagaagccctgcgcgt

SEQ ID NO: 211125 - DNA, 25 bp, E. coli
aattctgacatcctattttatggac

SEQ ID NO: 211126 - DNA, 25 bp, E. coli
aattctgacatcgtattttatggac

SEQ ID NO: 211127 - DNA, 25 bp, E. coli
caaattattagacgcaaacttgtca

SEQ ID NO: 211128 - DNA, 25 bp, E. coli
caaattattagaggcaaacttgtca

SEQ ID NO: 211129 - DNA, 25 bp, E. coli
taccttgggtttcataacaattcaa

SEQ ID NO: 211130 - DNA, 25 bp, E. coli
taccttgggtttgataacaattcaa

SEQ ID NO: 211131 - DNA, 25 bp, E. coli
tattagaggcaaacttgtcattttt

SEQ ID NO: 211132 - DNA, 25 bp, E. coli
tattagaggcaatcttgtcattttt

SEQ ID NO: 211133 - DNA, 25 bp, E. coli
tgtttaccttggctttgataacaat

SEQ ID NO: 211134 - DNA, 25 bp, E. coli
tgtttaccttgggtttgataacaat

SEQ ID NO: 211135 - DNA, 25 bp, E. coli
tctgacatcgtattttatggacata

SEQ ID NO: 211136 - DNA, 25 bp, E. coli
tctgacatcgtaatttatggacata

SEQ ID NO: 211137 - DNA, 25 bp, E. coli
ccttgggtttgaaaacaattcaaat

SEQ ID NO: 211138 - DNA, 25 bp, E. coli
ccttgggtttgataacaattcaaat

SEQ ID NO: 211139 - DNA, 25 bp, E. coli
gcttcaaattataagaggcaaactt

SEQ ID NO: 211140 - DNA, 25 bp, E. coli
gcttcaaattattagaggcaaactt

SEQ ID NO: 211141 - DNA, 25 bp, E. coli
gaggcaaacttgtcatttttttaat

SEQ ID NO: 211142 - DNA, 25 bp, E. coli
gaggcaaacttgacatttttttaat

SEQ ID NO: 211143 - DNA, 25 bp, E. coli
gacatcgtatttaatggacataaaa

SEQ ID NO: 211144 - DNA, 25 bp, E. coli
gacatcgtattttatggacataaaa

SEQ ID NO: 211145 - DNA, 25 bp, E. coli
gataacaattcatattctgacatcg

SEQ ID NO: 211146 - DNA, 25 bp, E. coli
gataacaattcaaattctgacatcg

SEQ ID NO: 211147 - DNA, 25 bp, E. coli
catggcgacgcaatcaccgtgttcg

SEQ ID NO: 211148 - DNA, 25 bp, E. coli
catggcgacgcattcaccgtgttcg

SEQ ID NO: 211149 - DNA, 25 bp, E. coli
tagcttcacagtggatcatacccgg

SEQ ID NO: 211150 - DNA, 25 bp, E. coli
tagcttcacagtcgatcatacccgg

SEQ ID NO: 211151 - DNA, 25 bp, E. coli
ttcgggtggcgataacaatgaacac

SEQ ID NO: 211152 - DNA, 25 bp, E. coli
ttcgggtggcgaaaacaatgaacac

SEQ ID NO: 211153 - DNA, 25 bp, E. coli
tatatgagtctgtttggtacgccag

SEQ ID NO: 211154 - DNA, 25 bp, E. coli
tatatgagtctgattggtacgccag

SEQ ID NO: 211155 - DNA, 25 bp, E. coli
tgccgaacaaagtagtgatgccaga

SEQ ID NO: 211156 - DNA, 25 bp, E. coli
tgccgaacaaagaagtgatgccaga

SEQ ID NO: 211157 - DNA, 25 bp, E. coli
tgccgcaccggtatttatatgagtc

SEQ ID NO: 211158 - DNA, 25 bp, E. coli
tgccgcaccggtttttatatgagtc

SEQ ID NO: 211159 - DNA, 25 bp, E. coli
tcgatatctcgccaatgggctgccg

SEQ ID NO: 211160 - DNA, 25 bp, E. coli
tcgatatctcgcgaatgggctgccg

SEQ ID NO: 211161 - DNA, 25 bp, E. coli
ccagtgtggcacttaccagatgcac

SEQ ID NO: 211162 - DNA, 25 bp, E. coli
ccagtgtggcacataccagatgcac

SEQ ID NO: 211163 - DNA, 25 bp, E. coli
gatctgcgcttcagcgtgccgaaca

SEQ ID NO: 211164 - DNA, 25 bp, E. coli
gatctgcgcttctgcgtgccgaaca

SEQ ID NO: 211165 - DNA, 25 bp, E. coli
gatgccagaaagtgggatccatacc

SEQ ID NO: 211166 - DNA, 25 bp, E. coli
gatgcactcgttgcaggaagcgcag

SEQ ID NO: 211167 - DNA, 25 bp, E. coli
gatgccagaaagagggatccatacc

SEQ ID NO: 211168 - DNA, 25 bp, E. coli
gatgcactcgttccaggaagcgcag

SEQ ID NO: 211169 - DNA, 25 bp, E. coli
caccgtgctggtggcggaactgtac

SEQ ID NO: 211170 - DNA, 25 bp, E. coli
caccgtgctggtcgcggaactgtac

SEQ ID NO: 211171 - DNA, 25 bp, E. coli
caggctacgttgatcgctgggataa

SEQ ID NO: 211172 - DNA, 25 bp, E. coli
caggctacgttgttcgctgggataa

SEQ ID NO: 211173 - DNA, 25 bp, E. coli
tactgaatggctagcggcgggtaat

SEQ ID NO: 211174 - DNA, 25 bp, E. coli
tactgaatggcttgcggcgggtaat

SEQ ID NO: 211175 - DNA, 25 bp, E. coli
tacagggcgcgaggttatcgaactg

SEQ ID NO: 211176 - DNA, 25 bp, E. coli
tacagggcgcgacgttatcgaactg

SEQ ID NO: 211177 - DNA, 25 bp, E. coli
agctttggctttcgctcccgtaagg

SEQ ID NO: 211178 - DNA, 25 bp, E. coli
agctttggctttggctcccgtaagg

SEQ ID NO: 211179 - DNA, 25 bp, E. coli
aaaatgccgcgtgcggataatcgcc

SEQ ID NO: 211180 - DNA, 25 bp, E. coli
aaaatgccgcgtccggataatcgcc

SEQ ID NO: 211181 - DNA, 25 bp, E. coli
tgggataccacaacagatccatgcg

SEQ ID NO: 211182 - DNA, 25 bp, E. coli
tgggataccacatcagatccatgcg

SEQ ID NO: 211183 - DNA, 25 bp, E. coli
gctgaaactggatgaggacgaaaca

SEQ ID NO: 211184 - DNA, 25 bp, E. coli
gctgaaactggaagaggacgaaaca

SEQ ID NO: 211185 - DNA, 25 bp, E. coli
cgttcgcggcctctatgagcatgac

SEQ ID NO: 211186 - DNA, 25 bp, E. coli
cgttcgcggcctgtatgagcatgac

SEQ ID NO: 211187 - DNA, 25 bp, E. coli
gtatgagcagcaccccgaaaaaatg

SEQ ID NO: 211188 - DNA, 25 bp, E. coli
gtatgagcagcagcccgaaaaaatg

SEQ ID NO: 211189 - DNA, 25 bp, E. coli
gataacctttcacagctgctatggg

SEQ ID NO: 211190 - DNA, 25 bp, E. coli
gataacctttcagagctgctatggg

SEQ ID NO: 211191 - DNA, 25 bp, E. coli
catcgtcaggcaggtaaagtcagtg

SEQ ID NO: 211192 - DNA, 25 bp, E. coli
catcgtcaggcacgtaaagtcagtg

SEQ ID NO: 211193 - DNA, 25 bp, E. coli
actctggaagtgacgcaggcgatcc

SEQ ID NO: 211194 - DNA, 25 bp, E. coli
actctggaagtgtcgcaggcgatcc

SEQ ID NO: 211195 - DNA, 25 bp, E. coli
tattctggcgaaggttgcggcaccg

SEQ ID NO: 211196 - DNA, 25 bp, E. coli
tattctggcgaacgttgcggcaccg

SEQ ID NO: 211197 - DNA, 25 bp, E. coli
tttacaccactatcgctgacggcga

SEQ ID NO: 211198 - DNA, 25 bp, E. coli
tttacaccactaacgctgacggcga

SEQ ID NO: 211199 - DNA, 25 bp, E. coli
tggtgaaaacgtacgatacgccgac

SEQ ID NO: 211200 - DNA, 25 bp, E. coli
tgccgatggcaaaacgctgtatgtc

SEQ ID NO: 211201 - DNA, 25 bp, E. coli
tgccgatggcaatacgctgtatgtc

SEQ ID NO: 211202 - DNA, 25 bp, E. coli
gctggatgacggcaaagagcacttc

SEQ ID NO: 211203 - DNA, 25 bp, E. coli
gctggatgacgggaaagagcacttc

SEQ ID NO: 211204 - DNA, 25 bp, E. coli
gaattgattaccttcgacaccgccg

SEQ ID NO: 211205 - DNA, 25 bp, E. coli
gcagaagtgttagtggtcgataccc

SEQ ID NO: 211206 - DNA, 25 bp, E. coli
gcagaagtgttactggtcgataccc

SEQ ID NO: 211207 - DNA, 25 bp, E. coli
gaattgattaccatcgacaccgccg

SEQ ID NO: 211208 - DNA, 25 bp, E. coli
gatctcaagccgtttggtgccacca

SEQ ID NO: 211209 - DNA, 25 bp, E. coli
gatctcaagccgattggtgccacca

SEQ ID NO: 211210 - DNA, 25 bp, E. coli
ggcttatagccaccaagaaaacgcg

SEQ ID NO: 211211 - DNA, 25 bp, E. coli
tggtgaaaacgttcgatacgccgac

SEQ ID NO: 211212 - DNA, 25 bp, E. coli
ggcttatagccagcaagaaaacgcg

SEQ ID NO: 211213 - DNA, 25 bp, E. coli
aagtggccattcatcagactcaggg

SEQ ID NO: 211214 - DNA, 25 bp, E. coli
aagtggccattcttcagactcaggg

SEQ ID NO: 211215 - DNA, 25 bp, E. coli
cagcttgcctcacagttgggcgtca

SEQ ID NO: 211216 - DNA, 25 bp, E. coli
cacagttgggcgacaatcgcggtga

SEQ ID NO: 211217 - DNA, 25 bp, E. coli
cacagttgggcgtcaatcgcggtga

SEQ ID NO: 211218 - DNA, 25 bp, E. coli
cagcttgcctcagagttgggcgtca

SEQ ID NO: 211219 - DNA, 25 bp, E. coli
ttcttcagactctggggctgactcc

SEQ ID NO: 211220 - DNA, 25 bp, E. coli
ttcttcagactcaggggctgactcc

SEQ ID NO: 211221 - DNA, 25 bp, E. coli
tcggtgaacagcttgcctcacagtt

SEQ ID NO: 211222 - DNA, 25 bp, E. coli
tcggtgaacagcatgcctcacagtt

SEQ ID NO: 211223 - DNA, 25 bp, E. coli
tgcctcacagttcggcgtcaatcgc

SEQ ID NO: 211224 - DNA, 25 bp, E. coli
tgcctcacagttgggcgtcaatcgc

SEQ ID NO: 211225 - DNA, 25 bp, E. coli
gcagggcgaagtcgccattcttcag

SEQ ID NO: 211226 - DNA, 25 bp, E. coli
gaagcagggcgatgtggccattctt

SEQ ID NO: 211227 - DNA, 25 bp, E. coli
gcagggcgaagtggccattcttcag

SEQ ID NO: 211228 - DNA, 25 bp, E. coli
gaagcagggcgaagtggccattctt

SEQ ID NO: 211229 - DNA, 25 bp, E. coli
gaacagcttgccacacagttgggcg

SEQ ID NO: 211230 - DNA, 25 bp, E. coli
gaacagcttgcctcacagttgggcg

SEQ ID NO: 211231 - DNA, 25 bp, E. coli
gttgggcgtcaatcgcggtgatcaa

SEQ ID NO: 211232 - DNA, 25 bp, E. coli
gttgggcgtcaaacgcggtgatcaa

SEQ ID NO: 211233 - DNA, 25 bp, E. coli
ggctgactccgcctcaaatcatgat

SEQ ID NO: 211234 - DNA, 25 bp, E. coli
ggctgactccgcgtcaaatcatgat

SEQ ID NO: 211235 - DNA, 25 bp, E. coli
caacaagcaggtgcggcactggcga

SEQ ID NO: 211236 - DNA, 25 bp, E. coli
caacaagcaggtccggcactggcga

SEQ ID NO: 211237 - DNA, 25 bp, E. coli
atcgtcccgcgggaacaatgggcgc

SEQ ID NO: 211238 - DNA, 25 bp, E. coli
atcgtcccgcggcaacaatgggcgc

SEQ ID NO: 211239 - DNA, 25 bp, E. coli
aactgctggagcaactcgatcaaca

SEQ ID NO: 211240 - DNA, 25 bp, E. coli
aactgctggagctactcgatcaaca

SEQ ID NO: 211241 - DNA, 25 bp, E. coli
tgtgtcgccggactaactgttcacg

SEQ ID NO: 211242 - DNA, 25 bp, E. coli
tgtgtcgccggagtaactgttcacg

SEQ ID NO: 211243 - DNA, 25 bp, E. coli
tcgatcaacaacaagcaggtgcggc

SEQ ID NO: 211244 - DNA, 25 bp, E. coli
tcgatcaacaactagcaggtgcggc

SEQ ID NO: 211245 - DNA, 25 bp, E. coli
gactaactgttcacgaactgctgga

SEQ ID NO: 211246 - DNA, 25 bp, E. coli
gactaactgttctcgaactgctgga

SEQ ID NO: 211247 - DNA, 25 bp, E. coli
ccgatgcagtgtgtcgccggactaa

SEQ ID NO: 211248 - DNA, 25 bp, E. coli
cgcgggaacaatcggcgcaacatat

SEQ ID NO: 211249 - DNA, 25 bp, E. coli
cgcgggaacaatgggcgcaacatat

SEQ ID NO: 211250 - DNA, 25 bp, E. coli
ccgatgcagtgtctcgccggactaa

SEQ ID NO: 211251 - DNA, 25 bp, E. coli
ggagcaactcgatcaacaacaagca

SEQ ID NO: 211252 - DNA, 25 bp, E. coli
ggagcaactcgaacaacaacaagca

SEQ ID NO: 211253 - DNA, 25 bp, E. coli
tcaacaacaagctggtgcggcactg

SEQ ID NO: 211254 - DNA, 25 bp, E. coli
tcaaccgatgcactgtgtcgccgga

SEQ ID NO: 211255 - DNA, 25 bp, E. coli
tcaaccgatgcagtgtgtcgccgga

SEQ ID NO: 211256 - DNA, 25 bp, E. coli
tcaacaacaagcaggtgcggcactg

SEQ ID NO: 211257 - DNA, 25 bp, E. coli
tactctggctgctgtacgcgatgcg

SEQ ID NO: 211258 - DNA, 25 bp, E. coli
tactctggctgcagtacgcgatgcg

SEQ ID NO: 211259 - DNA, 25 bp, E. coli
aaaatttgaggtcaaagccgctgcc

SEQ ID NO: 211260 - DNA, 25 bp, E. coli
aaaatttgaggtgaaagccgctgcc

SEQ ID NO: 211261 - DNA, 25 bp, E. coli
tgcatactctatggaacacccgggc

SEQ ID NO: 211262 - DNA, 25 bp, E. coli
tgcatactctatcgaacacccgggc

SEQ ID NO: 211263 - DNA, 25 bp, E. coli
tgcgccgtgctgatgaaggtactcc

SEQ ID NO: 211264 - DNA, 25 bp, E. coli
tgcgccgtgctgttgaaggtactcc

SEQ ID NO: 211265 - DNA, 25 bp, E. coli
tcgagtgcctgatagacgcgtttgt

SEQ ID NO: 211266 - DNA, 25 bp, E. coli
tcgagtgcctgaaagacgcgtttgt

SEQ ID NO: 211267 - DNA, 25 bp, E. coli
gccgacctacgaagaagcaattgca

SEQ ID NO: 211268 - DNA, 25 bp, E. coli
gccgacctacgatgaagcaattgca

SEQ ID NO: 211269 - DNA, 25 bp, E. coli
gcgctgctgctcctctgttcaaaga

SEQ ID NO: 211270 - DNA, 25 bp, E. coli
gcttcggctggcaaactggttcgta

SEQ ID NO: 211271 - DNA, 25 bp, E. coli
gcgctgctgctcgtctgttcaaaga

SEQ ID NO: 211272 - DNA, 25 bp, E. coli
gcttcggctggctaactggttcgta

SEQ ID NO: 211273 - DNA, 25 bp, E. coli
gattcccgtggcctaactgtagata

SEQ ID NO: 211274 - DNA, 25 bp, E. coli
gattcccgtggcgtaactgtagata

SEQ ID NO: 211275 - DNA, 25 bp, E. coli
gaagtcagcgaactagccaaaggcg

SEQ ID NO: 211276 - DNA, 25 bp, E. coli
gaagtcagcgaagtagccaaaggcg

SEQ ID NO: 211277 - DNA, 25 bp, E. coli
gatggcaaccatgaaagaagcttcg

SEQ ID NO: 211278 - DNA, 25 bp, E. coli
gatggcaaccatcaaagaagcttcg

SEQ ID NO: 211279 - DNA, 25 bp, E. coli
cagcgtgattgccacgcatgtgaac

SEQ ID NO: 211280 - DNA, 25 bp, E. coli
cagcgtgattgcgacgcatgtgaac

SEQ ID NO: 211281 - DNA, 25 bp, E. coli
tacggcaggtgaaatccgacggtaa

SEQ ID NO: 211282 - DNA, 25 bp, E. coli
tacggcaggtgatatccgacggtaa

SEQ ID NO: 211283 - DNA, 25 bp, E. coli
atgacatcacgcagctgcataaccg

SEQ ID NO: 211284 - DNA, 25 bp, E. coli
atgacatcacgctgctgcataaccg

SEQ ID NO: 211285 - DNA, 25 bp, E. coli
tatgatgacatctcgcagctgcata

SEQ ID NO: 211286 - DNA, 25 bp, E. coli
tatgatgacatcacgcagctgcata

SEQ ID NO: 211287 - DNA, 25 bp, E. coli
ttgtttaattatcatgacatcacgc

SEQ ID NO: 211288 - DNA, 25 bp, E. coli
ttgtttaattatgatgacatcacgc

SEQ ID NO: 211289 - DNA, 25 bp, E. coli
cgacagcgtgcctgtggacccgaat

SEQ ID NO: 211290 - DNA, 25 bp, E. coli
cgacagcgtgccagtggacccgaat

SEQ ID NO: 211291 - DNA, 25 bp, E. coli
cgtacggcaggtgatatccgacggt

SEQ ID NO: 211292 - DNA, 25 bp, E. coli
cgtacggcaggtcatatccgacggt

SEQ ID NO: 211293 - DNA, 25 bp, E. coli
cggcaggtgataaccgacggtaacg

SEQ ID NO: 211294 - DNA, 25 bp, E. coli
cggcaggtgatatccgacggtaacg

SEQ ID NO: 211295 - DNA, 25 bp, E. coli
gtgattgccacggatgtgaacaaga

SEQ ID NO: 211296 - DNA, 25 bp, E. coli
gattgccacgcaagtgaacaagatt

SEQ ID NO: 211297 - DNA, 25 bp, E. coli
gattgccacgcatgtgaacaagatt

SEQ ID NO: 211298 - DNA, 25 bp, E. coli
gtgattgccacgcatgtgaacaaga

SEQ ID NO: 211299 - DNA, 25 bp, E. coli
taattatgatgagatcacgcagctg

SEQ ID NO: 211300 - DNA, 25 bp, E. coli
taattatgatgacatcacgcagctg

SEQ ID NO: 211301 - DNA, 25 bp, E. coli
tagaagcggctcgtaagctcaaggt

SEQ ID NO: 211302 - DNA, 25 bp, E. coli
tagaagcggctcctaagctcaaggt

SEQ ID NO: 211303 - DNA, 25 bp, E. coli
tattcagacgcacggctttagcccg

SEQ ID NO: 211304 - DNA, 25 bp, E. coli
tattcagacgcagggctttagcccg

SEQ ID NO: 211305 - DNA, 25 bp, E. coli
tgatcagttcgccacagttgccgca

SEQ ID NO: 211306 - DNA, 25 bp, E. coli
tgaagtctgccgtatcctggatgcg

SEQ ID NO: 211307 - DNA, 25 bp, E. coli
tgacctccattgaaaagacccgtgt

SEQ ID NO: 211308 - DNA, 25 bp, E. coli
tgatcagttcgcgacagttgccgca

SEQ ID NO: 211309 - DNA, 25 bp, E. coli
tgaagtctgccgaatcctggatgcg

SEQ ID NO: 211310 - DNA, 25 bp, E. coli
tgacctccattgtaaagacccgtgt

SEQ ID NO: 211311 - DNA, 25 bp, E. coli
tctggacgccaggaaagcggaattg

SEQ ID NO: 211312 - DNA, 25 bp, E. coli
tcgtgaagcgtttagccacagcggg

SEQ ID NO: 211313 - DNA, 25 bp, E. coli
tcgtgaagcgttaagccacagcggg

SEQ ID NO: 211314 - DNA, 25 bp, E. coli
tctggacgccagcaaagcggaattg

SEQ ID NO: 211315 - DNA, 25 bp, E. coli
gcggaattgctcacttatcaggaca

SEQ ID NO: 211316 - DNA, 25 bp, E. coli
gcggaattgctctcttatcaggaca

SEQ ID NO: 211317 - DNA, 25 bp, E. coli
gaaacggagatggaaaaggcacgcc

SEQ ID NO: 211318 - DNA, 25 bp, E. coli
gaaacggagatgcaaaaggcacgcc

SEQ ID NO: 211319 - DNA, 25 bp, E. coli
gaaagtcgccataaaacgctcggat

SEQ ID NO: 211320 - DNA, 25 bp, E. coli
gaaagtcgccattaaacgctcggat

SEQ ID NO: 211321 - DNA, 25 bp, E. coli
gatgaaaccgcacaaggcttcctga

SEQ ID NO: 211322 - DNA, 25 bp, E. coli
gatgaaaccgcagaaggcttcctga

SEQ ID NO: 211323 - DNA, 25 bp, E. coli
catgtgctggaacttcacgtgtgtg

SEQ ID NO: 211324 - DNA, 25 bp, E. coli
catgtgctggaagttcacgtgtgtg

SEQ ID NO: 211325 - DNA, 25 bp, E. coli
agaaagcgtcgagcgggctttaacg

SEQ ID NO: 211326 - DNA, 25 bp, E. coli
agaaagcgtcgaccgggctttaacg

SEQ ID NO: 211327 - DNA, 25 bp, E. coli
gggctttaacgtccgctaactgcgg

SEQ ID NO: 211328 - DNA, 25 bp, E. coli
gggctttaacgtgcgctaactgcgg

SEQ ID NO: 211329 - DNA, 25 bp, E. coli
tttaacgtgcgcaaactgcggtcag

SEQ ID NO: 211330 - DNA, 25 bp, E. coli
tttaacgtgcgctaactgcggtcag

SEQ ID NO: 211331 - DNA, 25 bp, E. coli
tcgagcgggcttaaacgtgcgctaa

SEQ ID NO: 211332 - DNA, 25 bp, E. coli
tcgagcgggctttaacgtgcgctaa

SEQ ID NO: 211333 - DNA, 25 bp, E. coli
gctgcatgtgctcgaagttcacgtg

SEQ ID NO: 211334 - DNA, 25 bp, E. coli
gctgcatgtgctggaagttcacgtg

SEQ ID NO: 211335 - DNA, 25 bp, E. coli
gaagctgcatgtcctggaagttcac

SEQ ID NO: 211336 - DNA, 25 bp, E. coli
gaagctgcatgtgctggaagttcac

SEQ ID NO: 211337 - DNA, 25 bp, E. coli
cgtgcgctaactgcggtcagaagct

SEQ ID NO: 211338 - DNA, 25 bp, E. coli
cggtcagaagctgcatgtgctggaa

SEQ ID NO: 211339 - DNA, 25 bp, E. coli
cgtgcgctaactccggtcagaagct

SEQ ID NO: 211340 - DNA, 25 bp, E. coli
cggtcagaagctccatgtgctggaa

SEQ ID NO: 211341 - DNA, 25 bp, E. coli
ggaagttcacgtgtgtgagcactgc

SEQ ID NO: 211342 - DNA, 25 bp, E. coli
ggaagttcacgtctgtgagcactgc

SEQ ID NO: 211343 - DNA, 25 bp, E. coli
taacgtgcgctaactgcggtcagaa

SEQ ID NO: 211344 - DNA, 25 bp, E. coli
taacgtgcgctatctgcggtcagaa

SEQ ID NO: 211345 - DNA, 25 bp, E. coli
cagtgccggatgactgccaggttta

SEQ ID NO: 211346 - DNA, 25 bp, E. coli
cagtgccggatgtctgccaggttta

SEQ ID NO: 211347 - DNA, 25 bp, E. coli
atgccagtgccggatgtctgccagg

SEQ ID NO: 211348 - DNA, 25 bp, E. coli
agtgccggatgtgtgccaggtttac

SEQ ID NO: 211349 - DNA, 25 bp, E. coli
atgccagtgccgcatgtctgccagg

SEQ ID NO: 211350 - DNA, 25 bp, E. coli
agtgccggatgtctgccaggtttac

SEQ ID NO: 211351 - DNA, 25 bp, E. coli
tgccagtgccggatgtctgccaggt

SEQ ID NO: 211352 - DNA, 25 bp, E. coli
tgccagtgccggttgtctgccaggt

SEQ ID NO: 211353 - DNA, 25 bp, E. coli
tctgccaggttttcccacttttaat

SEQ ID NO: 211354 - DNA, 25 bp, E. coli
tctgccaggtttacccacttttaat

SEQ ID NO: 211355 - DNA, 25 bp, E. coli
ccagtgccggatctctgccaggttt

SEQ ID NO: 211356 - DNA, 25 bp, E. coli
gccagtgccggaagtctgccaggtt

SEQ ID NO: 211357 - DNA, 25 bp, E. coli
gccagtgccggatgtctgccaggtt

SEQ ID NO: 211358 - DNA, 25 bp, E. coli
ccagtgccggatgtctgccaggttt

SEQ ID NO: 211359 - DNA, 25 bp, E. coli
gcagactgcacggcaccatttactg

SEQ ID NO: 211360 - DNA, 25 bp, E. coli
gcagactgcacgccaccatttactg

SEQ ID NO: 211361 - DNA, 25 bp, E. coli
ccggatgtctgcgaggtttacccac

SEQ ID NO: 211362 - DNA, 25 bp, E. coli
ccggatgtctgccaggtttacccac

SEQ ID NO: 211363 - DNA, 25 bp, E. coli
ctgcacgccaccttttactgccctt

SEQ ID NO: 211364 - DNA, 25 bp, E. coli
ctgcacgccaccatttactgccctt

SEQ ID NO: 211365 - DNA, 25 bp, E. coli
gtgccggatgtcagccaggtttacc

SEQ ID NO: 211366 - DNA, 25 bp, E. coli
gtgccggatgtctgccaggtttacc

SEQ ID NO: 211367 - DNA, 25 bp, E. coli
aatccattaactaccgtaccgcgcg

SEQ ID NO: 211368 - DNA, 25 bp, E. coli
cagcagtaattgtcagcaaggctac

SEQ ID NO: 211369 - DNA, 25 bp, E. coli
cagcagtaattgacagcaaggctac

SEQ ID NO: 211370 - DNA, 25 bp, E. coli
cagaggccgtgagccagcagtaatt

SEQ ID NO: 211371 - DNA, 25 bp, E. coli
cagaggccgtgacccagcagtaatt

SEQ ID NO: 211372 - DNA, 25 bp, E. coli
aatccattaacttccgtaccgcgcg

SEQ ID NO: 211373 - DNA, 25 bp, E. coli
tttgcatccctgtttgacaccctgg

SEQ ID NO: 211374 - DNA, 25 bp, E. coli
tttgcatccctgattgacaccctgg

SEQ ID NO: 211375 - DNA, 25 bp, E. coli
tcgaagcctacataaaagcggcgct

SEQ ID NO: 211376 - DNA, 25 bp, E. coli
tcgaagcctacaaaaaagcggcgct

SEQ ID NO: 211377 - DNA, 25 bp, E. coli
tctgaagtgctcaacaatgttgaag

SEQ ID NO: 211378 - DNA, 25 bp, E. coli
tctgaagtgctctacaatgttgaag

SEQ ID NO: 211379 - DNA, 25 bp, E. coli
cgcgcgcggcaagctttctgaagtg

SEQ ID NO: 211380 - DNA, 25 bp, E. coli
cgcgcgcggcaacctttctgaagtg

SEQ ID NO: 211381 - DNA, 25 bp, E. coli
cggcgctggatgctgaatttgcatc

SEQ ID NO: 211382 - DNA, 25 bp, E. coli
cggcgctggatggtgaatttgcatc

SEQ ID NO: 211383 - DNA, 25 bp, E. coli
tggactccaccaacaaggaactggt

SEQ ID NO: 211384 - DNA, 25 bp, E. coli
tggactccaccatcaaggaactggt

SEQ ID NO: 211385 - DNA, 25 bp, E. coli
tcagcaaggctagtttcgaagccta

SEQ ID NO: 211386 - DNA, 25 bp, E. coli
tcagcaaggctactttcgaagccta

SEQ ID NO: 211387 - DNA, 25 bp, E. coli
gaggttgaaatctcccgcagaggcc

SEQ ID NO: 211388 - DNA, 25 bp, E. coli
gaggttgaaatcacccgcagaggcc

SEQ ID NO: 211389 - DNA, 25 bp, E. coli
caccgctgcgcgactgaatcaagaa

SEQ ID NO: 211390 - DNA, 25 bp, E. coli
caccgctgcgcgtctgaatcaagaa

SEQ ID NO: 211391 - DNA, 25 bp, E. coli
aacaagtgaacgaccgcgtctgatt

SEQ ID NO: 211392 - DNA, 25 bp, E. coli
aaacccgtattttcatgtatcaaag

SEQ ID NO: 211393 - DNA, 25 bp, E. coli
aaacccgtatttacatgtatcaaag

SEQ ID NO: 211394 - DNA, 25 bp, E. coli
aacaagtgaacgtccgcgtctgatt

SEQ ID NO: 211395 - DNA, 25 bp, E. coli
taccgcaatgcggtgtaatcgcgtg

SEQ ID NO: 211396 - DNA, 25 bp, E. coli
taccgcaatgcgctgtaatcgcgtg

SEQ ID NO: 211397 - DNA, 25 bp, E. coli
tatagcggcaaacaaacgcacaccg

SEQ ID NO: 211398 - DNA, 25 bp, E. coli
tatagcggcaaagaaacgcacaccg

SEQ ID NO: 211399 - DNA, 25 bp, E. coli
tctgatttatttcgctatagcggca

SEQ ID NO: 211400 - DNA, 25 bp, E. coli
tctgatttatttggctatagcggca

SEQ ID NO: 211401 - DNA, 25 bp, E. coli
gcgtctgaatcatgaaaacccgtat

SEQ ID NO: 211402 - DNA, 25 bp, E. coli
gcgtctgaatcaagaaaacccgtat

SEQ ID NO: 211403 - DNA, 25 bp, E. coli
cgaccgcgtctgattttctgattta

SEQ ID NO: 211404 - DNA, 25 bp, E. coli
cgaccgcgtctgtttttctgattta

SEQ ID NO: 211405 - DNA, 25 bp, E. coli
tggttgctgaacaagtgaacgaccg

SEQ ID NO: 211406 - DNA, 25 bp, E. coli
tggttgctgaactagtgaacgaccg

SEQ ID NO: 211407 - DNA, 25 bp, E. coli
taatcgcgtgaattatacggtcaac

SEQ ID NO: 211408 - DNA, 25 bp, E. coli
tcaatggcttttgatctggttgctg

SEQ ID NO: 211409 - DNA, 25 bp, E. coli
tcaatggcttttcatctggttgctg

SEQ ID NO: 211410 - DNA, 25 bp, E. coli
taatcgcgtgaaatatacggtcaac

SEQ ID NO: 211411 - DNA, 25 bp, E. coli
cacagatggctgaagtcggtttcat

SEQ ID NO: 211412 - DNA, 25 bp, E. coli
cacagatggctgtagtcggtttcat

SEQ ID NO: 211413 - DNA, 25 bp, E. coli
taaatggctgcgtgcggaacgtgca

SEQ ID NO: 211414 - DNA, 25 bp, E. coli
taaatggctgcgagcggaacgtgca

SEQ ID NO: 211415 - DNA, 25 bp, E. coli
aaagactggcattccatttggctga

SEQ ID NO: 211416 - DNA, 25 bp, E. coli
aaagactggcataccatttggctga

SEQ ID NO: 211417 - DNA, 25 bp, E. coli
tatagctccaaagggattgctgcga

SEQ ID NO: 211418 - DNA, 25 bp, E. coli
tatagctccaaacggattgctgcga

SEQ ID NO: 211419 - DNA, 25 bp, E. coli
tctgagcggtatggcagtggattac

SEQ ID NO: 211420 - DNA, 25 bp, E. coli
tctgagcggtatcgcagtggattac

SEQ ID NO: 211421 - DNA, 25 bp, E. coli
gcccgtaatcctgagtttgctgata

SEQ ID NO: 211422 - DNA, 25 bp, E. coli
gcttcgtggtgaaatacccgtccat

SEQ ID NO: 211423 - DNA, 25 bp, E. coli
gcccgtaatcctcagtttgctgata

SEQ ID NO: 211424 - DNA, 25 bp, E. coli
gcgcaaatgtcgctatggtctatag

SEQ ID NO: 211425 - DNA, 25 bp, E. coli
gcttcgtggtgatatacccgtccat

SEQ ID NO: 211426 - DNA, 25 bp, E. coli
gcgcaaatgtcggtatggtctatag

SEQ ID NO: 211427 - DNA, 25 bp, E. coli
cgcccagggcctttttatgacgatg

SEQ ID NO: 211428 - DNA, 25 bp, E. coli
cgcccagggcctatttatgacgatg

SEQ ID NO: 211429 - DNA, 25 bp, E. coli
tggcgatccatctccaaccgggttt

SEQ ID NO: 211430 - DNA, 25 bp, E. coli
tggcgatccatcaccaaccgggttt

SEQ ID NO: 211431 - DNA, 25 bp, E. coli
taatacccttcaatttaccggcgca

SEQ ID NO: 211432 - DNA, 25 bp, E. coli
taatacccttcattttaccggcgca

SEQ ID NO: 211433 - DNA, 25 bp, E. coli
cacgatttgtgaccttgcggaaaca

SEQ ID NO: 211434 - DNA, 25 bp, E. coli
cacgatttgtgagcttgcggaaaca

SEQ ID NO: 211435 - DNA, 25 bp, E. coli
taaactgcttttgctcggttcgtcg

SEQ ID NO: 211436 - DNA, 25 bp, E. coli
taaactgcttttcctcggttcgtcg

SEQ ID NO: 211437 - DNA, 25 bp, E. coli
agtaattctcatgtgattccggcgc

SEQ ID NO: 211438 - DNA, 25 bp, E. coli
agtaattctcatctgattccggcgc

SEQ ID NO: 211439 - DNA, 25 bp, E. coli
tattggaacaggtattgactgcacg

SEQ ID NO: 211440 - DNA, 25 bp, E. coli
tattggaacaggaattgactgcacg

SEQ ID NO: 211441 - DNA, 25 bp, E. coli
tgatgctgtggaaaacaattctccg

SEQ ID NO: 211442 - DNA, 25 bp, E. coli
tgatgctgtggataacaattctccg

SEQ ID NO: 211443 - DNA, 25 bp, E. coli
gaatgtcattcatgctgcccacaaa

SEQ ID NO: 211444 - DNA, 25 bp, E. coli
gaatgtcattcaagctgcccacaaa

SEQ ID NO: 211445 - DNA, 25 bp, E. coli
cttataaccgtcagtttgggcgtga

SEQ ID NO: 211446 - DNA, 25 bp, E. coli
cgttcgatacaagaaagcccgatgg

SEQ ID NO: 211447 - DNA, 25 bp, E. coli
cgttcgatacaacaaagcccgatgg

SEQ ID NO: 211448 - DNA, 25 bp, E. coli
cttataaccgtctgtttgggcgtga

SEQ ID NO: 211449 - DNA, 25 bp, E. coli
tggttggatcagctattacccgacg

SEQ ID NO: 211450 - DNA, 25 bp, E. coli
tggttggatcaggtattacccgacg

SEQ ID NO: 211451 - DNA, 25 bp, E. coli
tggcagcagcaaaagtcggaggtat

SEQ ID NO: 211452 - DNA, 25 bp, E. coli
tggcagcagcaatagtcggaggtat

SEQ ID NO: 211453 - DNA, 25 bp, E. coli
gatggagcccctggaaaactacttg

SEQ ID NO: 211454 - DNA, 25 bp, E. coli
gatggagcccctcgaaaactacttg

SEQ ID NO: 211455 - DNA, 25 bp, E. coli
cagaccgaatggtagtttgccgata

SEQ ID NO: 211456 - DNA, 25 bp, E. coli
cagaccgaatggaagtttgccgata

SEQ ID NO: 211457 - DNA, 25 bp, E. coli
caaatttactaaagccctggcagcc

SEQ ID NO: 211458 - DNA, 25 bp, E. coli
caaatttactaatgccctggcagcc

SEQ ID NO: 211459 - DNA, 25 bp, E. coli
tataaagagatgcagaaacgtggct

SEQ ID NO: 211460 - DNA, 25 bp, E. coli
tataaagagatggagaaacgtggct

SEQ ID NO: 211461 - DNA, 25 bp, E. coli
ttaagattgccgtgccggatggcga

SEQ ID NO: 211462 - DNA, 25 bp, E. coli
ttaagattgccgagccggatggcga

SEQ ID NO: 211463 - DNA, 25 bp, E. coli
tgttaacgccaaaggtaagccaatg

SEQ ID NO: 211464 - DNA, 25 bp, E. coli
tgttaacgccaatggtaagccaatg

SEQ ID NO: 211465 - DNA, 25 bp, E. coli
gctatggcggagaacctgaagctcg

SEQ ID NO: 211466 - DNA, 25 bp, E. coli
gctatggcggagtacctgaagctcg

SEQ ID NO: 211467 - DNA, 25 bp, E. coli
gaagagccgtggttccagaccgaat

SEQ ID NO: 211468 - DNA, 25 bp, E. coli
gaagagccgtggatccagaccgaat

SEQ ID NO: 211469 - DNA, 25 bp, E. coli
cgcgtggctacgatatgaaagtcat

SEQ ID NO: 211470 - DNA, 25 bp, E. coli
cgcgtggctacgttatgaaagtcat

SEQ ID NO: 211471 - DNA, 25 bp, E. coli
gttatgtcacaatccgctatggcgg

SEQ ID NO: 211472 - DNA, 25 bp, E. coli
gttatgtcacaaaccgctatggcgg

SEQ ID NO: 211473 - DNA, 25 bp, E. coli
ggtatgaacgacagcaccgtgctgg

SEQ ID NO: 211474 - DNA, 25 bp, E. coli
ggtatgaacgactgcaccgtgctgg

SEQ ID NO: 211475 - DNA, 25 bp, E. coli
tcaatgctggttgaacatccggaag

SEQ ID NO: 211476 - DNA, 25 bp, E. coli
tcaatgctggttcaacatccggaag

SEQ ID NO: 211477 - DNA, 25 bp, E. coli
cagatgatgtaacgctcttgcgtca

SEQ ID NO: 211478 - DNA, 25 bp, E. coli
cagatgatgtaaggctcttgcgtca

SEQ ID NO: 211479 - DNA, 25 bp, E. coli
atattgtcatcacgcctctgtccgg

SEQ ID NO: 211480 - DNA, 25 bp, E. coli
atattgtcatcaggcctctgtccgg

SEQ ID NO: 211481 - DNA, 25 bp, E. coli
tgagccatcggatagaccatattgt

SEQ ID NO: 211482 - DNA, 25 bp, E. coli
tgagccatcggaaagaccatattgt

SEQ ID NO: 211483 - DNA, 25 bp, E. coli
tccggtaaaagacgatgaccctcgt

SEQ ID NO: 211484 - DNA, 25 bp, E. coli
tccggtaaaagaggatgaccctcgt

SEQ ID NO: 211485 - DNA, 25 bp, E. coli
tctgcggtgcagttgtggagccatt

SEQ ID NO: 211486 - DNA, 25 bp, E. coli
tctgtccgggttgacgaaaaagagc

SEQ ID NO: 211487 - DNA, 25 bp, E. coli
tctgtccgggttcacgaaaaagagc

SEQ ID NO: 211488 - DNA, 25 bp, E. coli
tctgcggtgcagatgtggagccatt

SEQ ID NO: 211489 - DNA, 25 bp, E. coli
gactggatgctctctgtggcgaaaa

SEQ ID NO: 211490 - DNA, 25 bp, E. coli
gactggatgctcactgtggcgaaaa

SEQ ID NO: 211491 - DNA, 25 bp, E. coli
gaaaaagagcgtcaggtccgctgta

SEQ ID NO: 211492 - DNA, 25 bp, E. coli
gaaaaagagcgtgaggtccgctgta

SEQ ID NO: 211493 - DNA, 25 bp, E. coli
cgcggatacgcacggcgacaaaatc

SEQ ID NO: 211494 - DNA, 25 bp, E. coli
cgcggatacgcagggcgacaaaatc

SEQ ID NO: 211495 - DNA, 25 bp, E. coli
ctaattcagattgagcgtaacgcga

SEQ ID NO: 211496 - DNA, 25 bp, E. coli
ctaattcagattcagcgtaacgcga

SEQ ID NO: 211497 - DNA, 25 bp, E. coli
ggcgaaaagagaaaccagactggca

SEQ ID NO: 211498 - DNA, 25 bp, E. coli
ggcgaaaagagataccagactggca

SEQ ID NO: 211499 - DNA, 25 bp, E. coli
cacggctgcaccattggcaatcgag

SEQ ID NO: 211500 - DNA, 25 bp, E. coli
cacggctgcacctttggcaatcgag

SEQ ID NO: 211501 - DNA, 25 bp, E. coli
cagatccgcccgataagtgatgaag

SEQ ID NO: 211502 - DNA, 25 bp, E. coli
cagatccgcccgttaagtgatgaag

SEQ ID NO: 211503 - DNA, 25 bp, E. coli
cattatgtacagatcggagcacgca

SEQ ID NO: 211504 - DNA, 25 bp, E. coli
agaaggctgggtaacgctattccgc

SEQ ID NO: 211505 - DNA, 25 bp, E. coli
agaaggctgggttacgctattccgc

SEQ ID NO: 211506 - DNA, 25 bp, E. coli
tttttccacaaaacggtcagcgcgt

SEQ ID NO: 211507 - DNA, 25 bp, E. coli
tttttccacaaatcggtcagcgcgt

SEQ ID NO: 211508 - DNA, 25 bp, E. coli
tcgtctcaacggtggcgcattatag

SEQ ID NO: 211509 - DNA, 25 bp, E. coli
tcgtctcaacggaggcgcattatag

SEQ ID NO: 211510 - DNA, 25 bp, E. coli
tctgatgttttacgcccataccgcg

SEQ ID NO: 211511 - DNA, 25 bp, E. coli
tctgatgttttaggcccataccgcg

SEQ ID NO: 211512 - DNA, 25 bp, E. coli
cattatgtacagttcggagcacgca

SEQ ID NO: 211513 - DNA, 25 bp, E. coli
ggtcacaaggtgttgctccacggct

SEQ ID NO: 211514 - DNA, 25 bp, E. coli
ggtcacaaggtgatgctccacggct

SEQ ID NO: 211515 - DNA, 25 bp, E. coli
tggtcccacaaaataaacggctgga

SEQ ID NO: 211516 - DNA, 25 bp, E. coli
tggtcccacaaattaaacggctgga

SEQ ID NO: 211517 - DNA, 25 bp, E. coli
taaccattggcgtagatgtcactgt

SEQ ID NO: 211518 - DNA, 25 bp, E. coli
taaccattggcgaagatgtcactgt

SEQ ID NO: 211519 - DNA, 25 bp, E. coli
gagcacgcaccaatatccaggatgg

SEQ ID NO: 211520 - DNA, 25 bp, E. coli
gagcacgcaccattatccaggatgg

SEQ ID NO: 211521 - DNA, 25 bp, E. coli
cagcaacagtaacatatttgcccgt

SEQ ID NO: 211522 - DNA, 25 bp, E. coli
catatttgcccgttgatgcagggag

SEQ ID NO: 211523 - DNA, 25 bp, E. coli
catatttgcccgatgatgcagggag

SEQ ID NO: 211524 - DNA, 25 bp, E. coli
cagcaacagtaagatatttgcccgt

SEQ ID NO: 211525 - DNA, 25 bp, E. coli
aaagattcctgtagattctaactcc

SEQ ID NO: 211526 - DNA, 25 bp, E. coli
aaagattcctgttgattctaactcc

SEQ ID NO: 211527 - DNA, 25 bp, E. coli
tttgcccgttgatgcagggagacgt

SEQ ID NO: 211528 - DNA, 25 bp, E. coli
tttgcccgttgaagcagggagacgt

SEQ ID NO: 211529 - DNA, 25 bp, E. coli
tgattttggctatgctgggtttggt

SEQ ID NO: 211530 - DNA, 25 bp, E. coli
tgattttggctaagctgggtttggt

SEQ ID NO: 211531 - DNA, 25 bp, E. coli
tgaaaagattcctgtagattctaac

SEQ ID NO: 211532 - DNA, 25 bp, E. coli
tgaaaagattccagtagattctaac

SEQ ID NO: 211533 - DNA, 25 bp, E. coli
ccgaaatgattttggctatgctggg

SEQ ID NO: 211534 - DNA, 25 bp, E. coli
ccgaaatgatttaggctatgctggg

SEQ ID NO: 211535 - DNA, 25 bp, E. coli
gttggtggcattggactgttgttaa

SEQ ID NO: 211536 - DNA, 25 bp, E. coli
gttggtggcattcgactgttgttaa

SEQ ID NO: 211537 - DNA, 25 bp, E. coli
ggtttggtggcggatgtcctcctaa

SEQ ID NO: 211538 - DNA, 25 bp, E. coli
gggagacgtgatcgaacaaaactgc

SEQ ID NO: 211539 - DNA, 25 bp, E. coli
gggagacgtgatggaacaaaactgc

SEQ ID NO: 211540 - DNA, 25 bp, E. coli
ggtttggtggcgcatgtcctcctaa

SEQ ID NO: 211541 - DNA, 25 bp, E. coli
gagacgtgatggtacaaaactgccg

SEQ ID NO: 211542 - DNA, 25 bp, E. coli
gagacgtgatggaacaaaactgccg

SEQ ID NO: 211543 - DNA, 25 bp, E. coli
caattctttcttacaaaggtggagg

SEQ ID NO: 211544 - DNA, 25 bp, E. coli
caattctttctttcaaaggtggagg

SEQ ID NO: 211545 - DNA, 25 bp, E. coli
atctgttaccgggtaatgactccaa

SEQ ID NO: 211546 - DNA, 25 bp, E. coli
atctgttaccggctaatgactccaa

SEQ ID NO: 211547 - DNA, 25 bp, E. coli
tattcatttgcatccccatttcaca

SEQ ID NO: 211548 - DNA, 25 bp, E. coli
tattcatttgcaaccccatttcaca

SEQ ID NO: 211549 - DNA, 25 bp, E. coli
tttatcctcgcaaggcgaacgccac

SEQ ID NO: 211550 - DNA, 25 bp, E. coli
tttatcctcgcatggcgaacgccac

SEQ ID NO: 211551 - DNA, 25 bp, E. coli
tgcaaccccatttcacaattctttc

SEQ ID NO: 211552 - DNA, 25 bp, E. coli
tgcaaccccattacacaattctttc

SEQ ID NO: 211553 - DNA, 25 bp, E. coli
tcttacaaaggtcgaggcaaacccg

SEQ ID NO: 211554 - DNA, 25 bp, E. coli
tcttacaaaggtggaggcaaacccg

SEQ ID NO: 211555 - DNA, 25 bp, E. coli
cccgtccgtgtgtgaaaataatcgt

SEQ ID NO: 211556 - DNA, 25 bp, E. coli
cccgtccgtgtgagaaaataatcgt

SEQ ID NO: 211557 - DNA, 25 bp, E. coli
gtgtgtgaaaattatcgtatctgcc

SEQ ID NO: 211558 - DNA, 25 bp, E. coli
gtgtgtgaaaataatcgtatctgcc

SEQ ID NO: 211559 - DNA, 25 bp, E. coli
tgtgtaattattcatttgcaacccc

SEQ ID NO: 211560 - DNA, 25 bp, E. coli
tgtgtaattattgatttgcaacccc

SEQ ID NO: 211561 - DNA, 25 bp, E. coli
ggcgaacgccacatattgaattaaa

SEQ ID NO: 211562 - DNA, 25 bp, E. coli
ggcgaacgccacttattgaattaaa

SEQ ID NO: 211563 - DNA, 25 bp, E. coli
gaggcaaacccgaccgtgtgtgaaa

SEQ ID NO: 211564 - DNA, 25 bp, E. coli
gaggcaaacccgtccgtgtgtgaaa

SEQ ID NO: 211565 - DNA, 25 bp, E. coli
caaggtgccagataaacgttgtgga

SEQ ID NO: 211566 - DNA, 25 bp, E. coli
caaggtgccagaaaaacgttgtgga

SEQ ID NO: 211567 - DNA, 25 bp, E. coli
aattcacccgaatccatgagtgcgc

SEQ ID NO: 211568 - DNA, 25 bp, E. coli
aattcacccgaaaccatgagtgcgc

SEQ ID NO: 211569 - DNA, 25 bp, E. coli
caaattttgccacctggatcgcgtt

SEQ ID NO: 211570 - DNA, 25 bp, E. coli
caaattttgccagctggatcgcgtt

SEQ ID NO: 211571 - DNA, 25 bp, E. coli
tacttgcaacataccagctggtccg

SEQ ID NO: 211572 - DNA, 25 bp, E. coli
tacacttcgcgctcctgttacagca

SEQ ID NO: 211573 - DNA, 25 bp, E. coli
tacttgcaacattccagctggtccg

SEQ ID NO: 211574 - DNA, 25 bp, E. coli
tacacttcgcgcacctgttacagca

SEQ ID NO: 211575 - DNA, 25 bp, E. coli
attctgcaaaatgggataagtgacc

SEQ ID NO: 211576 - DNA, 25 bp, E. coli
attctgcaaaatcggataagtgacc

SEQ ID NO: 211577 - DNA, 25 bp, E. coli
tattttacgcttccggaaagtgctg

SEQ ID NO: 211578 - DNA, 25 bp, E. coli
tattttacgcttgcggaaagtgctg

SEQ ID NO: 211579 - DNA, 25 bp, E. coli
tgagtgcgccacctccaaattttgc

SEQ ID NO: 211580 - DNA, 25 bp, E. coli
tgagtgcgccacgtccaaattttgc

SEQ ID NO: 211581 - DNA, 25 bp, E. coli
tctcgccactggtctgatttctaag

SEQ ID NO: 211582 - DNA, 25 bp, E. coli
tctcgccactggactgatttctaag

SEQ ID NO: 211583 - DNA, 25 bp, E. coli
cggaaagtgctggtccagttgttaa

SEQ ID NO: 211584 - DNA, 25 bp, E. coli
cggaaagtgctgctccagttgttaa

SEQ ID NO: 211585 - DNA, 25 bp, E. coli
gatttctaagatctacctcagaccc

SEQ ID NO: 211586 - DNA, 25 bp, E. coli
gatttctaagatgtacctcagaccc

SEQ ID NO: 211587 - DNA, 25 bp, E. coli
caggcagcctttcctattttttaga

SEQ ID NO: 211588 - DNA, 25 bp, E. coli
catgctaaaaattcgaccgctgtaa

SEQ ID NO: 211589 - DNA, 25 bp, E. coli
caggcagcctttgctattttttaga

SEQ ID NO: 211590 - DNA, 25 bp, E. coli
catgctaaaaatacgaccgctgtaa

SEQ ID NO: 211591 - DNA, 25 bp, E. coli
tcgcatgttatcaccaatcaaaagg

SEQ ID NO: 211592 - DNA, 25 bp, E. coli
tcgcatgttatctccaatcaaaagg

SEQ ID NO: 211593 - DNA, 25 bp, E. coli
tcagtgccgagtacgacaataatcg

SEQ ID NO: 211594 - DNA, 25 bp, E. coli
gccacacccatcttaataatcgttg

SEQ ID NO: 211595 - DNA, 25 bp, E. coli
gccacacccatcataataatcgttg

SEQ ID NO: 211596 - DNA, 25 bp, E. coli
ccaatcaaaaggttgtgaatacgcc

SEQ ID NO: 211597 - DNA, 25 bp, E. coli
ccaatcaaaaggatgtgaatacgcc

SEQ ID NO: 211598 - DNA, 25 bp, E. coli
gcttaaattgcagaaaggctgcaca

SEQ ID NO: 211599 - DNA, 25 bp, E. coli
gcttaaattgcacaaaggctgcaca

SEQ ID NO: 211600 - DNA, 25 bp, E. coli
gctgtaatgaagtttacaaccggaa

SEQ ID NO: 211601 - DNA, 25 bp, E. coli
gcatagccgccattaaaaaaccatg

SEQ ID NO: 211602 - DNA, 25 bp, E. coli
gcatagccgccaataaaaaaccatg

SEQ ID NO: 211603 - DNA, 25 bp, E. coli
gctgtaatgaagattacaaccggaa

SEQ ID NO: 211604 - DNA, 25 bp, E. coli
cggaaaaataattccgattcgcatg

SEQ ID NO: 211605 - DNA, 25 bp, E. coli
cggaaaaataataccgattcgcatg

SEQ ID NO: 211606 - DNA, 25 bp, E. coli
tcagtgccgagttcgacaataatcg

SEQ ID NO: 211607 - DNA, 25 bp, E. coli
gaggtgacgttagcaccatcccagc

SEQ ID NO: 211608 - DNA, 25 bp, E. coli
gaggtgacgttaccaccatcccagc

SEQ ID NO: 211609 - DNA, 25 bp, E. coli
aattatgtggcggttatcaaccctc

SEQ ID NO: 211610 - DNA, 25 bp, E. coli
aaccctctcttcaggagtgaagtga

SEQ ID NO: 211611 - DNA, 25 bp, E. coli
aattatgtggcgcttatcaaccctc

SEQ ID NO: 211612 - DNA, 25 bp, E. coli
aaccctctcttctggagtgaagtga

SEQ ID NO: 211613 - DNA, 25 bp, E. coli
tattactctggcaacgtattcgaca

SEQ ID NO: 211614 - DNA, 25 bp, E. coli
tattactctggctacgtattcgaca

SEQ ID NO: 211615 - DNA, 25 bp, E. coli
tattcgacaaaaggcccaattgcag

SEQ ID NO: 211616 - DNA, 25 bp, E. coli
tattcgacaaaacgcccaattgcag

SEQ ID NO: 211617 - DNA, 25 bp, E. coli
ttgcaacgcgccctcgaaaaacatc

SEQ ID NO: 211618 - DNA, 25 bp, E. coli
ttgcaacgcgccgtcgaaaaacatc

SEQ ID NO: 211619 - DNA, 25 bp, E. coli
tttagtgagcgaagcagctgaacgc

SEQ ID NO: 211620 - DNA, 25 bp, E. coli
tttagtgagcgatgcagctgaacgc

SEQ ID NO: 211621 - DNA, 25 bp, E. coli
tgcactccagcccatcaaaagcgaa

SEQ ID NO: 211622 - DNA, 25 bp, E. coli
tgcactccagccgatcaaaagcgaa

SEQ ID NO: 211623 - DNA, 25 bp, E. coli
tcttatttttgcgttgcccgccggt

SEQ ID NO: 211624 - DNA, 25 bp, E. coli
tcttatttttgccttgcccgccggt

SEQ ID NO: 211625 - DNA, 25 bp, E. coli
cgttgttacgttggcctggtgagca

SEQ ID NO: 211626 - DNA, 25 bp, E. coli
cgttgttacgttcgcctggtgagca

SEQ ID NO: 211627 - DNA, 25 bp, E. coli
ggttaactggctccgcaaacgcggc

SEQ ID NO: 211628 - DNA, 25 bp, E. coli
ggttaactggctgcgcaaacgcggc

SEQ ID NO: 211629 - DNA, 25 bp, E. coli
gatgccgccgcaggtgtttatgcaa

SEQ ID NO: 211630 - DNA, 25 bp, E. coli
gatgccgccgcacgtgtttatgcaa

SEQ ID NO: 211631 - DNA, 25 bp, E. coli
cagcaaacgctgatttccccaggat

SEQ ID NO: 211632 - DNA, 25 bp, E. coli
cagcaaacgctgttttccccaggat

SEQ ID NO: 211633 - DNA, 25 bp, E. coli
aaccaaaacccgacgccatgtgcgg

SEQ ID NO: 211634 - DNA, 25 bp, E. coli
aaccaaaacccgtcgccatgtgcgg

SEQ ID NO: 211635 - DNA, 25 bp, E. coli
tatcaagcccggaggtttctcgcga

SEQ ID NO: 211636 - DNA, 25 bp, E. coli
tatcaagcccggtggtttctcgcga

SEQ ID NO: 211637 - DNA, 25 bp, E. coli
ttttttctggtttgcctggcaggcg

SEQ ID NO: 211638 - DNA, 25 bp, E. coli
ttttttctggttagcctggcaggcg

SEQ ID NO: 211639 - DNA, 25 bp, E. coli
tgtcacgattttgcgttacccttgc

SEQ ID NO: 211640 - DNA, 25 bp, E. coli
tgtcacgattttccgttacccttgc

SEQ ID NO: 211641 - DNA, 25 bp, E. coli
tgaaagcccattcttgaccgatccg

SEQ ID NO: 211642 - DNA, 25 bp, E. coli
tgcatctctttgaggtacagggaaa

SEQ ID NO: 211643 - DNA, 25 bp, E. coli
tgcatctctttgtggtacagggaaa

SEQ ID NO: 211644 - DNA, 25 bp, E. coli
tgaaagcccattgttgaccgatccg

SEQ ID NO: 211645 - DNA, 25 bp, E. coli
tccccaggataaatatcaagcccgg

SEQ ID NO: 211646 - DNA, 25 bp, E. coli
tccccaggataattatcaagcccgg

SEQ ID NO: 211647 - DNA, 25 bp, E. coli
gaagagtcagactcgttacgtaaga

SEQ ID NO: 211648 - DNA, 25 bp, E. coli
gaagagtcagacacgttacgtaaga

SEQ ID NO: 211649 - DNA, 25 bp, E. coli
gcaatgtttgcccaaccagcaggaa

SEQ ID NO: 211650 - DNA, 25 bp, E. coli
gcaatgtttgccgaaccagcaggaa

SEQ ID NO: 211651 - DNA, 25 bp, E. coli
gaccgatccgtctacgcctaatttt

SEQ ID NO: 211652 - DNA, 25 bp, E. coli
gaccgatccgtcaacgcctaatttt

SEQ ID NO: 211653 - DNA, 25 bp, E. coli
cagggcaagcatgcggaggcaaaac

SEQ ID NO: 211654 - DNA, 25 bp, E. coli
cagggcaagcatccggaggcaaaac

SEQ ID NO: 211655 - DNA, 25 bp, E. coli
acccagggcaagcatccggaggcaa

SEQ ID NO: 211656 - DNA, 25 bp, E. coli
agggcaagcatccggaggcaaaacg

SEQ ID NO: 211657 - DNA, 25 bp, E. coli
acccagggcaaggatccggaggcaa

SEQ ID NO: 211658 - DNA, 25 bp, E. coli
agggcaagcatcgggaggcaaaacg

SEQ ID NO: 211659 - DNA, 25 bp, E. coli
tacccagggcaagcatccggaggca

SEQ ID NO: 211660 - DNA, 25 bp, E. coli
tacccagggcaaccatccggaggca

SEQ ID NO: 211661 - DNA, 25 bp, E. coli
tgacccggaacatttacagaatggt

SEQ ID NO: 211662 - DNA, 25 bp, E. coli
tgacccggaacaattacagaatggt

SEQ ID NO: 211663 - DNA, 25 bp, E. coli
ccagggcaagcatccggaggcaaaa

SEQ ID NO: 211664 - DNA, 25 bp, E. coli
ccagggcaagcaaccggaggcaaaa

SEQ ID NO: 211665 - DNA, 25 bp, E. coli
cccagggcaagcttccggaggcaaa

SEQ ID NO: 211666 - DNA, 25 bp, E. coli
cccagggcaagcatccggaggcaaa

SEQ ID NO: 211667 - DNA, 25 bp, E. coli
ccggaacaattacagaatggtaaat

SEQ ID NO: 211668 - DNA, 25 bp, E. coli
ccggaacaattagagaatggtaaat

SEQ ID NO: 211669 - DNA, 25 bp, E. coli
gacccggaacaaatacagaatggta

SEQ ID NO: 211670 - DNA, 25 bp, E. coli
gacccggaacaattacagaatggta

SEQ ID NO: 211671 - DNA, 25 bp, E. coli
cacgccgtctgataagggttatcgc

SEQ ID NO: 211672 - DNA, 25 bp, E. coli
cacgccgtctgaaaagggttatcgc

SEQ ID NO: 211673 - DNA, 25 bp, E. coli
taactttggtcatttggccttgctg

SEQ ID NO: 211674 - DNA, 25 bp, E. coli
ataagccaggcgcaaggcatccgtg

SEQ ID NO: 211675 - DNA, 25 bp, E. coli
ataagccaggcggaaggcatccgtg

SEQ ID NO: 211676 - DNA, 25 bp, E. coli
agcaaaattcagcacgcccgtctgg

SEQ ID NO: 211677 - DNA, 25 bp, E. coli
agcaaaattcaggacgcccgtctgg

SEQ ID NO: 211678 - DNA, 25 bp, E. coli
tgcccgttgctgaagaatctttgcc

SEQ ID NO: 211679 - DNA, 25 bp, E. coli
tgcccgttgctgtagaatctttgcc

SEQ ID NO: 211680 - DNA, 25 bp, E. coli
gcatcaacatgcgattcgcacggta

SEQ ID NO: 211681 - DNA, 25 bp, E. coli
gcatcaacatgccattcgcacggta

SEQ ID NO: 211682 - DNA, 25 bp, E. coli
gcaacatcttgctttactggatacg

SEQ ID NO: 211683 - DNA, 25 bp, E. coli
gcaacatcttgcattactggatacg

SEQ ID NO: 211684 - DNA, 25 bp, E. coli
gattatgcgcattttaccccacaag

SEQ ID NO: 211685 - DNA, 25 bp, E. coli
gattatgcgcatattaccccacaag

SEQ ID NO: 211686 - DNA, 25 bp, E. coli
ggtaaacgctacttctggccgcatc

SEQ ID NO: 211687 - DNA, 25 bp, E. coli
ggtaaacgctacatctggccgcatc

SEQ ID NO: 211688 - DNA, 25 bp, E. coli
taactttggtcaattggccttgctg

SEQ ID NO: 211689 - DNA, 25 bp, E. coli
taacgtgagtggaatactgacgcgc

SEQ ID NO: 211690 - DNA, 25 bp, E. coli
taacgtgagtggtatactgacgcgc

SEQ ID NO: 211691 - DNA, 25 bp, E. coli
gacgcgctggcgtcagtttggtaaa

SEQ ID NO: 211692 - DNA, 25 bp, E. coli
gacgcgctggcgacagtttggtaaa

SEQ ID NO: 211693 - DNA, 25 bp, E. coli
caatcagcgatggtgctctgacggg

SEQ ID NO: 211694 - DNA, 25 bp, E. coli
caatcagcgatgctgctctgacggg

SEQ ID NO: 211695 - DNA, 25 bp, E. coli
cagtacaggacgacatgctgggagc

SEQ ID NO: 211696 - DNA, 25 bp, E. coli
cagtacaggacgtcatgctgggagc

SEQ ID NO: 211697 - DNA, 25 bp, E. coli
taccgggctaatcaaacacgccagt

SEQ ID NO: 211698 - DNA, 25 bp, E. coli
taccgggctaatgaaacacgccagt

SEQ ID NO: 211699 - DNA, 25 bp, E. coli
ccagacgggttaacggcagcaaaga

SEQ ID NO: 211700 - DNA, 25 bp, E. coli
ccagacgggttatcggcagcaaaga

SEQ ID NO: 211701 - DNA, 25 bp, E. coli
gaaccttgcagaggcgttcgagcat

SEQ ID NO: 211702 - DNA, 25 bp, E. coli
gaaccttgcagacgcgttcgagcat

SEQ ID NO: 211703 - DNA, 25 bp, E. coli
ccagttcgcccgcatgttgggactt

SEQ ID NO: 211704 - DNA, 25 bp, E. coli
ccagttcgcccggatgttgggactt

SEQ ID NO: 211705 - DNA, 25 bp, E. coli
gataatggttcaagctaccgggcta

SEQ ID NO: 211706 - DNA, 25 bp, E. coli
gataatggttcatgctaccgggcta

SEQ ID NO: 211707 - DNA, 25 bp, E. coli
ggacttgaaccgaagaacacggcgg

SEQ ID NO: 211708 - DNA, 25 bp, E. coli
tggccgtgaaagaaagcaatcagcg

SEQ ID NO: 211709 - DNA, 25 bp, E. coli
ggacttgaaccgtagaacacggcgg

SEQ ID NO: 211710 - DNA, 25 bp, E. coli
tggccgtgaaagtaagcaatcagcg

SEQ ID NO: 211711 - DNA, 25 bp, E. coli
taacgaatggcaaccgcatagtgcg

SEQ ID NO: 211712 - DNA, 25 bp, E. coli
tcacgttcgcgctggactgctgtga

SEQ ID NO: 211713 - DNA, 25 bp, E. coli
tcacgttcgcgcaggactgctgtga

SEQ ID NO: 211714 - DNA, 25 bp, E. coli
taacgaatggcatccgcatagtgcg

SEQ ID NO: 211715 - DNA, 25 bp, E. coli
caacgcccctgagagtgagtatcat

SEQ ID NO: 211716 - DNA, 25 bp, E. coli
caacgcccctgacagtgagtatcat

SEQ ID NO: 211717 - DNA, 25 bp, E. coli
agtaaaccgcaacgcccctgagagt

SEQ ID NO: 211718 - DNA, 25 bp, E. coli
agtaaaccgcaaggcccctgagagt

SEQ ID NO: 211719 - DNA, 25 bp, E. coli
tattcaggcaatcaattacttttgc

SEQ ID NO: 211720 - DNA, 25 bp, E. coli
tattcaggcaatgaattacttttgc

SEQ ID NO: 211721 - DNA, 25 bp, E. coli
ttttatcaggcttgaaatggcgtcc

SEQ ID NO: 211722 - DNA, 25 bp, E. coli
ttttatcaggctagaaatggcgtcc

SEQ ID NO: 211723 - DNA, 25 bp, E. coli
tgagttatgctgttttgttaagcag

SEQ ID NO: 211724 - DNA, 25 bp, E. coli
tgagttatgctgatttgttaagcag

SEQ ID NO: 211725 - DNA, 25 bp, E. coli
tccagccccgactggtgaatcgtcg

SEQ ID NO: 211726 - DNA, 25 bp, E. coli
tccagccccgacaggtgaatcgtcg

SEQ ID NO: 211727 - DNA, 25 bp, E. coli
tcaggcttgaaatggcgtccagccc

SEQ ID NO: 211728 - DNA, 25 bp, E. coli
tcaggcttgaaaaggcgtccagccc

SEQ ID NO: 211729 - DNA, 25 bp, E. coli
gaattacttttggaagccatcgcat

SEQ ID NO: 211730 - DNA, 25 bp, E. coli
gaattacttttgcaagccatcgcat

SEQ ID NO: 211731 - DNA, 25 bp, E. coli
gcaagccatcgctttctcttatgtt

SEQ ID NO: 211732 - DNA, 25 bp, E. coli
gcaagccatcgcattctcttatgtt

SEQ ID NO: 211733 - DNA, 25 bp, E. coli
ccctgagagtgagtatcatttataa

SEQ ID NO: 211734 - DNA, 25 bp, E. coli
ccctgagagtgactatcatttataa

SEQ ID NO: 211735 - DNA, 25 bp, E. coli
gatttgttaagcagttttatcaggc

SEQ ID NO: 211736 - DNA, 25 bp, E. coli
gatttgttaagctgttttatcaggc

SEQ ID NO: 211737 - DNA, 25 bp, E. coli
caccggaaaaacaacgctgctgaaa

SEQ ID NO: 211738 - DNA, 25 bp, E. coli
caccggaaaaactacgctgctgaaa

SEQ ID NO: 211739 - DNA, 25 bp, E. coli
caggaaaaacgaagataccgttact

SEQ ID NO: 211740 - DNA, 25 bp, E. coli
caggaaaaacgatgataccgttact

SEQ ID NO: 211741 - DNA, 25 bp, E. coli
catggagtggcaccggaaaaacaac

SEQ ID NO: 211742 - DNA, 25 bp, E. coli
catggagtggcagcggaaaaacaac

SEQ ID NO: 211743 - DNA, 25 bp, E. coli
accgggcaaagaaagttatgagctg

SEQ ID NO: 211744 - DNA, 25 bp, E. coli
accgggcaaagatagttatgagctg

SEQ ID NO: 211745 - DNA, 25 bp, E. coli
gctgctgaaaaaattgatcccggca

SEQ ID NO: 211746 - DNA, 25 bp, E. coli
gctgcatggagtggcaccggaaaaa

SEQ ID NO: 211747 - DNA, 25 bp, E. coli
gctgcatggagtcgcaccggaaaaa

SEQ ID NO: 211748 - DNA, 25 bp, E. coli
gctgctgaaaaatttgatcccggca

SEQ ID NO: 211749 - DNA, 25 bp, E. coli
cgctgctgaaaatattgatcccggc

SEQ ID NO: 211750 - DNA, 25 bp, E. coli
cgctgctgaaaaaattgatcccggc

SEQ ID NO: 211751 - DNA, 25 bp, E. coli
ctttgctgcatggagtggcaccgga

SEQ ID NO: 211752 - DNA, 25 bp, E. coli
ctttgctgcatgcagtggcaccgga

SEQ ID NO: 211753 - DNA, 25 bp, E. coli
ctcgcctttgctgcatggagtggca

SEQ ID NO: 211754 - DNA, 25 bp, E. coli
ctcgcctttgctccatggagtggca

SEQ ID NO: 211755 - DNA, 25 bp, E. coli
tggcaccggaaatacaacgctgctg

SEQ ID NO: 211756 - DNA, 25 bp, E. coli
tggcaccggaaaaacaacgctgctg

SEQ ID NO: 211757 - DNA, 25 bp, E. coli
gagtggcaccggaaaaacaacgctg

SEQ ID NO: 211758 - DNA, 25 bp, E. coli
gagtggcaccggtaaaacaacgctg

SEQ ID NO: 211759 - DNA, 25 bp, E. coli
cagcctgtatgattctcagctttat

SEQ ID NO: 211760 - DNA, 25 bp, E. coli
cgaactggccgcagaaaatgtccgc

SEQ ID NO: 211761 - DNA, 25 bp, E. coli
caacaaatgagtacgtcagagcgcg

SEQ ID NO: 211762 - DNA, 25 bp, E. coli
caacaaatgagttcgtcagagcgcg

SEQ ID NO: 211763 - DNA, 25 bp, E. coli
cagcctgtatgaatctcagctttat

SEQ ID NO: 211764 - DNA, 25 bp, E. coli
cgaactggccgctgaaaatgtccgc

SEQ ID NO: 211765 - DNA, 25 bp, E. coli
tacgcctgaattacgtaacgaagcc

SEQ ID NO: 211766 - DNA, 25 bp, E. coli
tacgcctgaatttcgtaacgaagcc

SEQ ID NO: 211767 - DNA, 25 bp, E. coli
tgaacgcatcggagtggccgccgca

SEQ ID NO: 211768 - DNA, 25 bp, E. coli
tgaacgcatcggtgtggccgccgca

SEQ ID NO: 211769 - DNA, 25 bp, E. coli
gccccgtaaacatcatacgcctgaa

SEQ ID NO: 211770 - DNA, 25 bp, E. coli
gccccgtaaacaacatacgcctgaa

SEQ ID NO: 211771 - DNA, 25 bp, E. coli
gcagtaaacagcagcaacaaatgag

SEQ ID NO: 211772 - DNA, 25 bp, E. coli
gcagtaaacagctgcaacaaatgag

SEQ ID NO: 211773 - DNA, 25 bp, E. coli
gtcagagcgcgaaagcgaactggcc

SEQ ID NO: 211774 - DNA, 25 bp, E. coli
gtatcaatcagcaagaagccccgta

SEQ ID NO: 211775 - DNA, 25 bp, E. coli
gtatcaatcagctagaagccccgta

SEQ ID NO: 211776 - DNA, 25 bp, E. coli
gtcagagcgcgatagcgaactggcc

SEQ ID NO: 211777 - DNA, 25 bp, E. coli
taacgaagccctgaaactcgctgaa

SEQ ID NO: 211778 - DNA, 25 bp, E. coli
tcagctttatgcctggcgcagtaaa

SEQ ID NO: 211779 - DNA, 25 bp, E. coli
taacgaagccctcaaactcgctgaa

SEQ ID NO: 211780 - DNA, 25 bp, E. coli
tcagctttatgcgtggcgcagtaaa

SEQ ID NO: 211781 - DNA, 25 bp, E. coli
aacgtgccaagtttcgtggccacgc

SEQ ID NO: 211782 - DNA, 25 bp, E. coli
aacgtgccaagtatcgtggccacgc

SEQ ID NO: 211783 - DNA, 25 bp, E. coli
tttaacgtgccaagtttcgtggcca

SEQ ID NO: 211784 - DNA, 25 bp, E. coli
tttaacgtgccatgtttcgtggcca

SEQ ID NO: 211785 - DNA, 25 bp, E. coli
ttgtttatgacctacgctctgccag

SEQ ID NO: 211786 - DNA, 25 bp, E. coli
ttgtttatgaccaacgctctgccag

SEQ ID NO: 211787 - DNA, 25 bp, E. coli
tgggcttgtttatgaccaacgctct

SEQ ID NO: 211788 - DNA, 25 bp, E. coli
tgggcttgtttaagaccaacgctct

SEQ ID NO: 211789 - DNA, 25 bp, E. coli
gcttgtttatgagcaacgctctgcc

SEQ ID NO: 211790 - DNA, 25 bp, E. coli
gcttgtttatgaccaacgctctgcc

SEQ ID NO: 211791 - DNA, 25 bp, E. coli
gaatgggcttgtttatgaccaacgc

SEQ ID NO: 211792 - DNA, 25 bp, E. coli
gaatgggcttgtatatgaccaacgc

SEQ ID NO: 211793 - DNA, 25 bp, E. coli
cgcggaatgggcttgtttatgacca

SEQ ID NO: 211794 - DNA, 25 bp, E. coli
cgcggaatgggcatgtttatgacca

SEQ ID NO: 211795 - DNA, 25 bp, E. coli
cggaatgggcttctttatgaccaac

SEQ ID NO: 211796 - DNA, 25 bp, E. coli
cggaatgggcttgtttatgaccaac

SEQ ID NO: 211797 - DNA, 25 bp, E. coli
ggcttgtttatgaccaacgctctgc

SEQ ID NO: 211798 - DNA, 25 bp, E. coli
tgtttaacgtgcgaagtttcgtggc

SEQ ID NO: 211799 - DNA, 25 bp, E. coli
tgtttaacgtgccaagtttcgtggc

SEQ ID NO: 211800 - DNA, 25 bp, E. coli
ggcttgtttatgtccaacgctctgc

SEQ ID NO: 211801 - DNA, 25 bp, E. coli
taacgtgccaagattcgtggccacg

SEQ ID NO: 211802 - DNA, 25 bp, E. coli
taacgtgccaagtttcgtggccacg

SEQ ID NO: 211803 - DNA, 25 bp, E. coli
aattgccaccatgatgcagaacccg

SEQ ID NO: 211804 - DNA, 25 bp, E. coli
aattgccaccatcatgcagaacccg

SEQ ID NO: 211805 - DNA, 25 bp, E. coli
caccgtttatcatcgccgatgaacc

SEQ ID NO: 211806 - DNA, 25 bp, E. coli
caccgtttatcaacgccgatgaacc

SEQ ID NO: 211807 - DNA, 25 bp, E. coli
catgttgcagcggatgatgattgcg

SEQ ID NO: 211808 - DNA, 25 bp, E. coli
catgttgcagcgcatgatgattgcg

SEQ ID NO: 211809 - DNA, 25 bp, E. coli
tacccgttcgagatgagcggcggca

SEQ ID NO: 211810 - DNA, 25 bp, E. coli
tacccgttcgagttgagcggcggca

SEQ ID NO: 211811 - DNA, 25 bp, E. coli
ttaccgctgccatagaagcggtggg

SEQ ID NO: 211812 - DNA, 25 bp, E. coli
ttaccgctgccaaagaagcggtggg

SEQ ID NO: 211813 - DNA, 25 bp, E. coli
tctacggtatggagctggcatcatg

SEQ ID NO: 211814 - DNA, 25 bp, E. coli
tcatctcgccctgtacggtatggag

SEQ ID NO: 211815 - DNA, 25 bp, E. coli
tctacggtatggtgctggcatcatg

SEQ ID NO: 211816 - DNA, 25 bp, E. coli
tcatctcgccctctacggtatggag

SEQ ID NO: 211817 - DNA, 25 bp, E. coli
gccgatgacgctacgcttaccgctg

SEQ ID NO: 211818 - DNA, 25 bp, E. coli
gccgatgacgcttcgcttaccgctg

SEQ ID NO: 211819 - DNA, 25 bp, E. coli
gccctgcgcggcttcaaaattgcca

SEQ ID NO: 211820 - DNA, 25 bp, E. coli
gccctgcgcggcatcaaaattgcca

SEQ ID NO: 211821 - DNA, 25 bp, E. coli
cgatctgctggaaagcattatgcaa

SEQ ID NO: 211822 - DNA, 25 bp, E. coli
cgatctgctggatagcattatgcaa

SEQ ID NO: 211823 - DNA, 25 bp, E. coli
gtaatatcgcgctacaggccgcgca

SEQ ID NO: 211824 - DNA, 25 bp, E. coli
gtaatatcgcgcaacaggccgcgca

SEQ ID NO: 211825 - DNA, 25 bp, E. coli
catgatgccggtactggtgctgaac

SEQ ID NO: 211826 - DNA, 25 bp, E. coli
catgatgccggttctggtgctgaac

SEQ ID NO: 211827 - DNA, 25 bp, E. coli
tacagcggcattacttgaggctccc

SEQ ID NO: 211828 - DNA, 25 bp, E. coli
tacagcggcatttcttgaggctccc

SEQ ID NO: 211829 - DNA, 25 bp, E. coli
aaaaattccgcggagacctggctga

SEQ ID NO: 211830 - DNA, 25 bp, E. coli
aaaaattccgcgcagacctggctga

SEQ ID NO: 211831 - DNA, 25 bp, E. coli
tgaaaatgacgcgaatgtacccacc

SEQ ID NO: 211832 - DNA, 25 bp, E. coli
tgaaaatgacgccaatgtacccacc

SEQ ID NO: 211833 - DNA, 25 bp, E. coli
tgctggtcagtcaaacggtatggct

SEQ ID NO: 211834 - DNA, 25 bp, E. coli
tgctggtcagtctaacggtatggct

SEQ ID NO: 211835 - DNA, 25 bp, E. coli
gaaggaaatctgaaagcccagggct

SEQ ID NO: 211836 - DNA, 25 bp, E. coli
gaaggaaatctgtaagcccagggct

SEQ ID NO: 211837 - DNA, 25 bp, E. coli
cgtattatgcagatagcccgtcgca

SEQ ID NO: 211838 - DNA, 25 bp, E. coli
cgtattatgcagttagcccgtcgca

SEQ ID NO: 211839 - DNA, 25 bp, E. coli
gatattgatgcgaagccgacggagc

SEQ ID NO: 211840 - DNA, 25 bp, E. coli
gatattgatgcgtagccgacggagc

SEQ ID NO: 211841 - DNA, 25 bp, E. coli
tggctaaagggctatatggcaccgt

SEQ ID NO: 211842 - DNA, 25 bp, E. coli
tggctaaagggcaatatggcaccgt

SEQ ID NO: 211843 - DNA, 25 bp, E. coli
taagtgctgatgttgccggtactgc

SEQ ID NO: 211844 - DNA, 25 bp, E. coli
taagtgctgatgatgccggtactgc

SEQ ID NO: 211845 - DNA, 25 bp, E. coli
taaagtttccggtggtacagcggca

SEQ ID NO: 211846 - DNA, 25 bp, E. coli
taaagtttccggaggtacagcggca

SEQ ID NO: 211847 - DNA, 25 bp, E. coli
ctttgtgtaatacttgtaacgctac

SEQ ID NO: 211848 - DNA, 25 bp, E. coli
ctttgtgtaatagttgtaacgctac

SEQ ID NO: 211849 - DNA, 25 bp, E. coli
tatctaaaacccagcgttcgatgct

SEQ ID NO: 211850 - DNA, 25 bp, E. coli
tatttaatcgattaccagaagcaat

SEQ ID NO: 211851 - DNA, 25 bp, E. coli
tatctaaaaccctgcgttcgatgct

SEQ ID NO: 211852 - DNA, 25 bp, E. coli
tatttaatcgataaccagaagcaat

SEQ ID NO: 211853 - DNA, 25 bp, E. coli
tctcactttatctaagatgaatccg

SEQ ID NO: 211854 - DNA, 25 bp, E. coli
tctcactttatcaaagatgaatccg

SEQ ID NO: 211855 - DNA, 25 bp, E. coli
gaagcaataaaaaatcaaatcggat

SEQ ID NO: 211856 - DNA, 25 bp, E. coli
gaagcaataaaatatcaaatcggat

SEQ ID NO: 211857 - DNA, 25 bp, E. coli
cgatgcttctttcagcgaacgatca

SEQ ID NO: 211858 - DNA, 25 bp, E. coli
cgatgcttctttgagcgaacgatca

SEQ ID NO: 211859 - DNA, 25 bp, E. coli
gtaacgctacatggagattaactca

SEQ ID NO: 211860 - DNA, 25 bp, E. coli
gtaacgctacatcgagattaactca

SEQ ID NO: 211861 - DNA, 25 bp, E. coli
tcaaaaataagtcccttcccatcaa

SEQ ID NO: 211862 - DNA, 25 bp, E. coli
taatttgtatatggaagcgccctga

SEQ ID NO: 211863 - DNA, 25 bp, E. coli
tcaaaaataagtgccttcccatcaa

SEQ ID NO: 211864 - DNA, 25 bp, E. coli
taatttgtatatcgaagcgccctga

SEQ ID NO: 211865 - DNA, 25 bp, E. coli
gatgaatccgatcgaagcatcctgt

SEQ ID NO: 211866 - DNA, 25 bp, E. coli
gatgaatccgatggaagcatcctgt

SEQ ID NO: 211867 - DNA, 25 bp, E. coli
gattaactcaatgtagagggtatta

SEQ ID NO: 211868 - DNA, 25 bp, E. coli
gattaactcaatctagagggtatta

SEQ ID NO: 211869 - DNA, 25 bp, E. coli
aatttcatcgcctggctgatcaact

SEQ ID NO: 211870 - DNA, 25 bp, E. coli
aacgacagtgaaattcatcgcctgg

SEQ ID NO: 211871 - DNA, 25 bp, E. coli
aatttcatcgccaggctgatcaact

SEQ ID NO: 211872 - DNA, 25 bp, E. coli
cagtgaatttcatcgcctggctgat

SEQ ID NO: 211873 - DNA, 25 bp, E. coli
cagtgaatttcaacgcctggctgat

SEQ ID NO: 211874 - DNA, 25 bp, E. coli
agtgaatttcatggcctggctgatc

SEQ ID NO: 211875 - DNA, 25 bp, E. coli
agtgaatttcatcgcctggctgatc

SEQ ID NO: 211876 - DNA, 25 bp, E. coli
aacgacagtgaatttcatcgcctgg

SEQ ID NO: 211877 - DNA, 25 bp, E. coli
tgaacgacagtgaatttcatcgcct

SEQ ID NO: 211878 - DNA, 25 bp, E. coli
tgaacgacagtgtatttcatcgcct

SEQ ID NO: 211879 - DNA, 25 bp, E. coli
gcaaaatcattaacaaccgccagga

SEQ ID NO: 211880 - DNA, 25 bp, E. coli
gaatttcatcgcctggctgatcaac

SEQ ID NO: 211881 - DNA, 25 bp, E. coli
gcagcaaaatcaatatcaaccgcca

SEQ ID NO: 211882 - DNA, 25 bp, E. coli
gcaaaatcattatcaaccgccagga

SEQ ID NO: 211883 - DNA, 25 bp, E. coli
gcagcaaaatcattatcaaccgcca

SEQ ID NO: 211884 - DNA, 25 bp, E. coli
gaatttcatcgcgtggctgatcaac

SEQ ID NO: 211885 - DNA, 25 bp, E. coli
gacagtgaatttcatcgcctggctg

SEQ ID NO: 211886 - DNA, 25 bp, E. coli
gacagtgaatttgatcgcctggctg

SEQ ID NO: 211887 - DNA, 25 bp, E. coli
cgctgcaccaggaatggctggcaac

SEQ ID NO: 211888 - DNA, 25 bp, E. coli
ccgctgcaccagctatggctggcaa

SEQ ID NO: 211889 - DNA, 25 bp, E. coli
cgctgcaccaggtatggctggcaac

SEQ ID NO: 211890 - DNA, 25 bp, E. coli
ccgctgcaccaggtatggctggcaa

SEQ ID NO: 211891 - DNA, 25 bp, E. coli
aataccgttggcattatcggtgcgc

SEQ ID NO: 211892 - DNA, 25 bp, E. coli
aataccgttggctttatcggtgcgc

SEQ ID NO: 211893 - DNA, 25 bp, E. coli
caatgatgataacgcgatgaaaaga

SEQ ID NO: 211894 - DNA, 25 bp, E. coli
caatgatgataaggcgatgaaaaga

SEQ ID NO: 211895 - DNA, 25 bp, E. coli
cattaacccgctctttattactgat

SEQ ID NO: 211896 - DNA, 25 bp, E. coli
cattaacccgctgtttattactgat

SEQ ID NO: 211897 - DNA, 25 bp, E. coli
ttgccaccaatgtcaaacgcccgga

SEQ ID NO: 211898 - DNA, 25 bp, E. coli
ttgccaccaatgacaaacgcccgga

SEQ ID NO: 211899 - DNA, 25 bp, E. coli
ttggctcaacaaagatgataacgcg

SEQ ID NO: 211900 - DNA, 25 bp, E. coli
ttggctcaacaatgatgataacgcg

SEQ ID NO: 211901 - DNA, 25 bp, E. coli
tgtctttgccacgaatgacaaacgc

SEQ ID NO: 211902 - DNA, 25 bp, E. coli
tgtctttgccaccaatgacaaacgc

SEQ ID NO: 211903 - DNA, 25 bp, E. coli
tgacaagcagatggacctgttggtg

SEQ ID NO: 211904 - DNA, 25 bp, E. coli
tgacaagcagatcgacctgttggtg

SEQ ID NO: 211905 - DNA, 25 bp, E. coli
gaaagatgacaaccagatcgacctg

SEQ ID NO: 211906 - DNA, 25 bp, E. coli
gaaagatgacaagcagatcgacctg

SEQ ID NO: 211907 - DNA, 25 bp, E. coli
ccgttggctttatcggtgcgcagac

SEQ ID NO: 211908 - DNA, 25 bp, E. coli
ccgttggctttaacggtgcgcagac

SEQ ID NO: 211909 - DNA, 25 bp, E. coli
ggaaaccttgctgaataccgttggc

SEQ ID NO: 211910 - DNA, 25 bp, E. coli
ggaaaccttgctcaataccgttggc

SEQ ID NO: 211911 - DNA, 25 bp, E. coli
taacgcgatgaaaagaaaaatattc

SEQ ID NO: 211912 - DNA, 25 bp, E. coli
taacgcgatgaatagaaaaatattc

SEQ ID NO: 211913 - DNA, 25 bp, E. coli
tacgcattggtaagcgcctgcagac

SEQ ID NO: 211914 - DNA, 25 bp, E. coli
tacgcattggtatgcgcctgcagac

SEQ ID NO: 211915 - DNA, 25 bp, E. coli
tgctgcgtatcgtaccggatctttc

SEQ ID NO: 211916 - DNA, 25 bp, E. coli
tgaccgtgcgcgtgatgctgaaatt

SEQ ID NO: 211917 - DNA, 25 bp, E. coli
tgaccgtgcgcgagatgctgaaatt

SEQ ID NO: 211918 - DNA, 25 bp, E. coli
tgctgcgtatcgaaccggatctttc

SEQ ID NO: 211919 - DNA, 25 bp, E. coli
tgcggacggtctgccttataaagat

SEQ ID NO: 211920 - DNA, 25 bp, E. coli
tgcggacggtctcccttataaagat

SEQ ID NO: 211921 - DNA, 25 bp, E. coli
gctttacaccgcagatgaccgtgcg

SEQ ID NO: 211922 - DNA, 25 bp, E. coli
gctttacaccgctgatgaccgtgcg

SEQ ID NO: 211923 - DNA, 25 bp, E. coli
gcaaactttctcgtgcagacctgga

SEQ ID NO: 211924 - DNA, 25 bp, E. coli
gcaaactttctcctgcagacctgga

SEQ ID NO: 211925 - DNA, 25 bp, E. coli
gacacctggatgaataccgccaata

SEQ ID NO: 211926 - DNA, 25 bp, E. coli
gacacctggatgtataccgccaata

SEQ ID NO: 211927 - DNA, 25 bp, E. coli
cggattcgctgaaggctgctgcgca

SEQ ID NO: 211928 - DNA, 25 bp, E. coli
cggattcgctgatggctgctgcgca

SEQ ID NO: 211929 - DNA, 25 bp, E. coli
gattgaaggttggttctggccagac

SEQ ID NO: 211930 - DNA, 25 bp, E. coli
gattgaaggttgcttctggccagac

SEQ ID NO: 211931 - DNA, 25 bp, E. coli
ggcacttgaactcgaaaacccggag

SEQ ID NO: 211932 - DNA, 25 bp, E. coli
ggcacttgaactggaaaacccggag

SEQ ID NO: 211933 - DNA, 25 bp, E. coli
tcaagcgagcgctcaagaaaatggt

SEQ ID NO: 211934 - DNA, 25 bp, E. coli
tcaagcgagcgcacaagaaaatggt

SEQ ID NO: 211935 - DNA, 25 bp, E. coli
tacggtgccgacactgcaataagct

SEQ ID NO: 211936 - DNA, 25 bp, E. coli
atgtatcgaaacatacggtgccgac

SEQ ID NO: 211937 - DNA, 25 bp, E. coli
atgtatcgaaacttacggtgccgac

SEQ ID NO: 211938 - DNA, 25 bp, E. coli
acgggccagtttcagttatctggaa

SEQ ID NO: 211939 - DNA, 25 bp, E. coli
acgggccagtttgagttatctggaa

SEQ ID NO: 211940 - DNA, 25 bp, E. coli
aaatgtccgcgcagtaaaaccctca

SEQ ID NO: 211941 - DNA, 25 bp, E. coli
aaatgtccgcgctgtaaaaccctca

SEQ ID NO: 211942 - DNA, 25 bp, E. coli
tacggtgccgactctgcaataagct

SEQ ID NO: 211943 - DNA, 25 bp, E. coli
ttatctggaagtaaaatgtccgcgc

SEQ ID NO: 211944 - DNA, 25 bp, E. coli
ttatctggaagttaaatgtccgcgc

SEQ ID NO: 211945 - DNA, 25 bp, E. coli
tgcaataagctactggcacgggcca

SEQ ID NO: 211946 - DNA, 25 bp, E. coli
tgcaataagctagtggcacgggcca

SEQ ID NO: 211947 - DNA, 25 bp, E. coli
gaagtaaaatgtccgcgctgtaaaa

SEQ ID NO: 211948 - DNA, 25 bp, E. coli
gaagtaaaatgtgcgcgctgtaaaa

SEQ ID NO: 211949 - DNA, 25 bp, E. coli
gaaacatacggtcccgacactgcaa

SEQ ID NO: 211950 - DNA, 25 bp, E. coli
gaaacatacggtgccgacactgcaa

SEQ ID NO: 211951 - DNA, 25 bp, E. coli
cgcgctgtaaaaccctcaatcaaat

SEQ ID NO: 211952 - DNA, 25 bp, E. coli
cgcgctgtaaaagcctcaatcaaat

SEQ ID NO: 211953 - DNA, 25 bp, E. coli
ctcaatcaaatctcatctccgagcg

SEQ ID NO: 211954 - DNA, 25 bp, E. coli
ctcaatcaaatcacatctccgagcg

SEQ ID NO: 211955 - DNA, 25 bp, E. coli
tggcacgggccagtttcagttatct

SEQ ID NO: 211956 - DNA, 25 bp, E. coli
tggcacgggccactttcagttatct

SEQ ID NO: 211957 - DNA, 25 bp, E. coli
catgattggacggtgtaaggacaac

SEQ ID NO: 211958 - DNA, 25 bp, E. coli
catgattggacgctgtaaggacaac

SEQ ID NO: 211959 - DNA, 25 bp, E. coli
taaaaggatacggaaaggagccgcg

SEQ ID NO: 211960 - DNA, 25 bp, E. coli
tacagagcagactgaaggaaagcaa

SEQ ID NO: 211961 - DNA, 25 bp, E. coli
tacagagcagacagaaggaaagcaa

SEQ ID NO: 211962 - DNA, 25 bp, E. coli
taaaaggatacgcaaaggagccgcg

SEQ ID NO: 211963 - DNA, 25 bp, E. coli
tcatagacgaagagactcccgctgt

SEQ ID NO: 211964 - DNA, 25 bp, E. coli
tcttttaggaccaacaatgggacca

SEQ ID NO: 211965 - DNA, 25 bp, E. coli
tcatagacgaagtgactcccgctgt

SEQ ID NO: 211966 - DNA, 25 bp, E. coli
tcttttaggacctacaatgggacca

SEQ ID NO: 211967 - DNA, 25 bp, E. coli
gccgcggctcctcgtaacatgaaag

SEQ ID NO: 211968 - DNA, 25 bp, E. coli
gccgcggctcctggtaacatgaaag

SEQ ID NO: 211969 - DNA, 25 bp, E. coli
cgaccagacggtcaggagacataaa

SEQ ID NO: 211970 - DNA, 25 bp, E. coli
cgaccagacggtgaggagacataaa

SEQ ID NO: 211971 - DNA, 25 bp, E. coli
gttagaagtctcagcaaaacaccga

SEQ ID NO: 211972 - DNA, 25 bp, E. coli
gttacacaaccaattcagactccgc

SEQ ID NO: 211973 - DNA, 25 bp, E. coli
gttagaagtctctgcaaaacaccga

SEQ ID NO: 211974 - DNA, 25 bp, E. coli
gttacacaaccatttcagactccgc

SEQ ID NO: 211975 - DNA, 25 bp, E. coli
ggtaacatgaaaccccacagatgtg

SEQ ID NO: 211976 - DNA, 25 bp, E. coli
ggtaacatgaaagcccacagatgtg

SEQ ID NO: 211977 - DNA, 25 bp, E. coli
taaggacaacacgaacaaaaacagg

SEQ ID NO: 211978 - DNA, 25 bp, E. coli
taaggacaacaccaacaaaaacagg

SEQ ID NO: 211979 - DNA, 25 bp, E. coli
acaagcgggcgtaggcaagatcatt

SEQ ID NO: 211980 - DNA, 25 bp, E. coli
aacaggccgcccctgtgtttgccgt

SEQ ID NO: 211981 - DNA, 25 bp, E. coli
aacaggccgcccgtgtgtttgccgt

SEQ ID NO: 211982 - DNA, 25 bp, E. coli
acaagcgggcgttggcaagatcatt

SEQ ID NO: 211983 - DNA, 25 bp, E. coli
tttagtggcgatcaagaggccagcc

SEQ ID NO: 211984 - DNA, 25 bp, E. coli
ttatcgacacccactgccattttga

SEQ ID NO: 211985 - DNA, 25 bp, E. coli
ttatcgacaccctctgccattttga

SEQ ID NO: 211986 - DNA, 25 bp, E. coli
ttgcgagttacgaccggaaccggcg

SEQ ID NO: 211987 - DNA, 25 bp, E. coli
ttgcgagttacgtccggaaccggcg

SEQ ID NO: 211988 - DNA, 25 bp, E. coli
tttagtggcgatgaagaggccagcc

SEQ ID NO: 211989 - DNA, 25 bp, E. coli
tgatttgccgttttatcgacaccca

SEQ ID NO: 211990 - DNA, 25 bp, E. coli
tgatttgccgttatatcgacaccca

SEQ ID NO: 211991 - DNA, 25 bp, E. coli
tccggcgacagaggcggaaaatttt

SEQ ID NO: 211992 - DNA, 25 bp, E. coli
tccggcgacagacgcggaaaatttt

SEQ ID NO: 211993 - DNA, 25 bp, E. coli
gccattttgatttcccgccgtttag

SEQ ID NO: 211994 - DNA, 25 bp, E. coli
gccattttgattacccgccgtttag

SEQ ID NO: 211995 - DNA, 25 bp, E. coli
gcggaaaattttccccgcgtgcagg

SEQ ID NO: 211996 - DNA, 25 bp, E. coli
gcggaaaattttgcccgcgtgcagg

SEQ ID NO: 211997 - DNA, 25 bp, E. coli
gcaagatcattgatccggcgacaga

SEQ ID NO: 211998 - DNA, 25 bp, E. coli
gcaagatcattgttccggcgacaga

SEQ ID NO: 211999 - DNA, 25 bp, E. coli
gacgcaccagatttgccgctcaatg

SEQ ID NO: 212000 - DNA, 25 bp, E. coli
gacgcaccagatatgccgctcaatg

SEQ ID NO: 212001 - DNA, 25 bp, E. coli
caatttgaagacttcatgacggtga

SEQ ID NO: 212002 - DNA, 25 bp, E. coli
caatttgaagacatcatgacggtga

SEQ ID NO: 212003 - DNA, 25 bp, E. coli
cagctgcgggatccacttttgacga

SEQ ID NO: 212004 - DNA, 25 bp, E. coli
cagctgcgggatgcacttttgacga

SEQ ID NO: 212005 - DNA, 25 bp, E. coli
aaagaaccgctgttttccctgctgg

SEQ ID NO: 212006 - DNA, 25 bp, E. coli
aaagaaccgctgatttccctgctgg

SEQ ID NO: 212007 - DNA, 25 bp, E. coli
tttcagcaacaagtcagactggcat

SEQ ID NO: 212008 - DNA, 25 bp, E. coli
ttattctgcggctattcgttccggc

SEQ ID NO: 212009 - DNA, 25 bp, E. coli
tttcagcaacaactcagactggcat

SEQ ID NO: 212010 - DNA, 25 bp, E. coli
ttattctgcggcaattcgttccggc

SEQ ID NO: 212011 - DNA, 25 bp, E. coli
tgtttccgggcatgtaggaagtcga

SEQ ID NO: 212012 - DNA, 25 bp, E. coli
tgtttccgggcaagtaggaagtcga

SEQ ID NO: 212013 - DNA, 25 bp, E. coli
taggaagtcgagtggacggaacacc

SEQ ID NO: 212014 - DNA, 25 bp, E. coli
taggaagtcgagaggacggaacacc

SEQ ID NO: 212015 - DNA, 25 bp, E. coli
gataatttgcatgcgaccctggcag

SEQ ID NO: 212016 - DNA, 25 bp, E. coli
gataatttgcatccgaccctggcag

SEQ ID NO: 212017 - DNA, 25 bp, E. coli
ggcgatttgctgtttgtttccgggc

SEQ ID NO: 212018 - DNA, 25 bp, E. coli
ggcgatttgctgattgtttccgggc

SEQ ID NO: 212019 - DNA, 25 bp, E. coli
gacgatatcattcatgttacgagct

SEQ ID NO: 212020 - DNA, 25 bp, E. coli
gacgatatcattgatgttacgagct

SEQ ID NO: 212021 - DNA, 25 bp, E. coli
ggaacaccagaacccgattttcagc

SEQ ID NO: 212022 - DNA, 25 bp, E. coli
ggaacaccagaagccgattttcagc

SEQ ID NO: 212023 - DNA, 25 bp, E. coli
catcattgggacagctattttgcat

SEQ ID NO: 212024 - DNA, 25 bp, E. coli
catcattgggactgctattttgcat

SEQ ID NO: 212025 - DNA, 25 bp, E. coli
tacattcattcatcattgggacagc

SEQ ID NO: 212026 - DNA, 25 bp, E. coli
tacattcattcaacattgggacagc

SEQ ID NO: 212027 - DNA, 25 bp, E. coli
agtattacattctttcatcattggg

SEQ ID NO: 212028 - DNA, 25 bp, E. coli
agtattacattcattcatcattggg

SEQ ID NO: 212029 - DNA, 25 bp, E. coli
acagctattttggataatgccatga

SEQ ID NO: 212030 - DNA, 25 bp, E. coli
acagctattttgcataatgccatga

SEQ ID NO: 212031 - DNA, 25 bp, E. coli
tattacattcatacatcattgggac

SEQ ID NO: 212032 - DNA, 25 bp, E. coli
tattacattcattcatcattgggac

SEQ ID NO: 212033 - DNA, 25 bp, E. coli
tgggacagctatattgcataatgcc

SEQ ID NO: 212034 - DNA, 25 bp, E. coli
tgggacagctattttgcataatgcc

SEQ ID NO: 212035 - DNA, 25 bp, E. coli
tcatcattgggacagctattttgca

SEQ ID NO: 212036 - DNA, 25 bp, E. coli
tcatcattgggagagctattttgca

SEQ ID NO: 212037 - DNA, 25 bp, E. coli
tcattgggacaggtattttgcataa

SEQ ID NO: 212038 - DNA, 25 bp, E. coli
tcattgggacagctattttgcataa

SEQ ID NO: 212039 - DNA, 25 bp, E. coli
tcattcatcattcggacagctattt

SEQ ID NO: 212040 - DNA, 25 bp, E. coli
tcattcatcattgggacagctattt

SEQ ID NO: 212041 - DNA, 25 bp, E. coli
cattcattcatctttgggacagcta

SEQ ID NO: 212042 - DNA, 25 bp, E. coli
cattcattcatcattgggacagcta

SEQ ID NO: 212043 - DNA, 25 bp, E. coli
ggacagctattttgcataatgccat

SEQ ID NO: 212044 - DNA, 25 bp, E. coli
ggacagctatttagcataatgccat

SEQ ID NO: 212045 - DNA, 25 bp, E. coli
caataacaatccattactggaatca

SEQ ID NO: 212046 - DNA, 25 bp, E. coli
caataacaatcctttactggaatca

SEQ ID NO: 212047 - DNA, 25 bp, E. coli
catttgtagcacaagtaagtgtcag

SEQ ID NO: 212048 - DNA, 25 bp, E. coli
tatgccgtgcacgtctgctgctacg

SEQ ID NO: 212049 - DNA, 25 bp, E. coli
tatgccgtgcacctctgctgctacg

SEQ ID NO: 212050 - DNA, 25 bp, E. coli
tgagtgccactacaagggatctgcg

SEQ ID NO: 212051 - DNA, 25 bp, E. coli
tgagtgccactagaagggatctgcg

SEQ ID NO: 212052 - DNA, 25 bp, E. coli
tcggaagggattgtgagtgccacta

SEQ ID NO: 212053 - DNA, 25 bp, E. coli
tcggaagggattctgagtgccacta

SEQ ID NO: 212054 - DNA, 25 bp, E. coli
gctgctacgctttttgtcatttgta

SEQ ID NO: 212055 - DNA, 25 bp, E. coli
gctgctacgcttattgtcatttgta

SEQ ID NO: 212056 - DNA, 25 bp, E. coli
gaatctttacattatgccgtgcacg

SEQ ID NO: 212057 - DNA, 25 bp, E. coli
gcacaagtaagtctcagcagtggtg

SEQ ID NO: 212058 - DNA, 25 bp, E. coli
gaatctttacataatgccgtgcacg

SEQ ID NO: 212059 - DNA, 25 bp, E. coli
gcacaagtaagtgtcagcagtggtg

SEQ ID NO: 212060 - DNA, 25 bp, E. coli
cgcatcagactggtcggaagggatt

SEQ ID NO: 212061 - DNA, 25 bp, E. coli
cgcatcagactgctcggaagggatt

SEQ ID NO: 212062 - DNA, 25 bp, E. coli
catttgtagcactagtaagtgtcag

SEQ ID NO: 212063 - DNA, 25 bp, E. coli
gggatctgcgtcacatttttcataa

SEQ ID NO: 212064 - DNA, 25 bp, E. coli
gggatctgcgtctcatttttcataa

SEQ ID NO: 212065 - DNA, 25 bp, E. coli
tactggaatcatttggaatctttac

SEQ ID NO: 212066 - DNA, 25 bp, E. coli
tactggaatcatatggaatctttac

SEQ ID NO: 212067 - DNA, 25 bp, E. coli
aaccggtaggcgttctggtcgttga

SEQ ID NO: 212068 - DNA, 25 bp, E. coli
cagatttgacgaccagatggccaga

SEQ ID NO: 212069 - DNA, 25 bp, E. coli
cagatttgacgagcagatggccaga

SEQ ID NO: 212070 - DNA, 25 bp, E. coli
aacgctggtcctatccggcaatcag

SEQ ID NO: 212071 - DNA, 25 bp, E. coli
aaacagcggcagacgttgaacagtc

SEQ ID NO: 212072 - DNA, 25 bp, E. coli
aacgctggtcctttccggcaatcag

SEQ ID NO: 212073 - DNA, 25 bp, E. coli
aaacagcggcagtcgttgaacagtc

SEQ ID NO: 212074 - DNA, 25 bp, E. coli
aaccggtaggcgatctggtcgttga

SEQ ID NO: 212075 - DNA, 25 bp, E. coli
tatgctggtcctgtccagagccggg

SEQ ID NO: 212076 - DNA, 25 bp, E. coli
tatgctggtcctctccagagccggg

SEQ ID NO: 212077 - DNA, 25 bp, E. coli
tataaagccgccttgcgtatgctgc

SEQ ID NO: 212078 - DNA, 25 bp, E. coli
tataaagccgccatgcgtatgctgc

SEQ ID NO: 212079 - DNA, 25 bp, E. coli
ttaaccagaccaccgagtcactcag

SEQ ID NO: 212080 - DNA, 25 bp, E. coli
ttaaccagaccagcgagtcactcag

SEQ ID NO: 212081 - DNA, 25 bp, E. coli
tgtccgatttcatcaaaacgctggt

SEQ ID NO: 212082 - DNA, 25 bp, E. coli
tgtccgatttcaacaaaacgctggt

SEQ ID NO: 212083 - DNA, 25 bp, E. coli
tccatcagccagagtgtggcgcgtt

SEQ ID NO: 212084 - DNA, 25 bp, E. coli
tccatcagccagtgtgtggcgcgtt

SEQ ID NO: 212085 - DNA, 25 bp, E. coli
gacaaggtcgctgaagccttcggga

SEQ ID NO: 212086 - DNA, 25 bp, E. coli
gacaaggtcgctcaagccttcggga

SEQ ID NO: 212087 - DNA, 25 bp, E. coli
tcactcagcgcagtggttaaggcgg

SEQ ID NO: 212088 - DNA, 25 bp, E. coli
tcactcagcgcactggttaaggcgg

SEQ ID NO: 212089 - DNA, 25 bp, E. coli
taccgaaggcgcgttcgaaggcttt

SEQ ID NO: 212090 - DNA, 25 bp, E. coli
taccgaaggcgccttcgaaggcttt

SEQ ID NO: 212091 - DNA, 25 bp, E. coli
ttcatcagctatcggtatataaacc

SEQ ID NO: 212092 - DNA, 25 bp, E. coli
ttcatcagctatgggtatataaacc

SEQ ID NO: 212093 - DNA, 25 bp, E. coli
tccggcaaccccatatccgggtgat

SEQ ID NO: 212094 - DNA, 25 bp, E. coli
tccggcaaccccttatccgggtgat

SEQ ID NO: 212095 - DNA, 25 bp, E. coli
tccgggtgataacgtgattattacc

SEQ ID NO: 212096 - DNA, 25 bp, E. coli
tccgggtgataaggtgattattacc

SEQ ID NO: 212097 - DNA, 25 bp, E. coli
ccgaaggcgcgtacgaaggctttca

SEQ ID NO: 212098 - DNA, 25 bp, E. coli
ggcaaccccttatccgggtgataag

SEQ ID NO: 212099 - DNA, 25 bp, E. coli
ggcaaccccttaaccgggtgataag

SEQ ID NO: 212100 - DNA, 25 bp, E. coli
gaaagacattgtcgatccggcaacc

SEQ ID NO: 212101 - DNA, 25 bp, E. coli
gaaagacattgtggatccggcaacc

SEQ ID NO: 212102 - DNA, 25 bp, E. coli
gacattgtcgatccggcaacccctt

SEQ ID NO: 212103 - DNA, 25 bp, E. coli
gacattgtcgatgcggcaacccctt

SEQ ID NO: 212104 - DNA, 25 bp, E. coli
ccaactacctgtatgtggaatttga

SEQ ID NO: 212105 - DNA, 25 bp, E. coli
ccaactacctgtttgtggaatttga

SEQ ID NO: 212106 - DNA, 25 bp, E. coli
ccgaaggcgcgttcgaaggctttca

SEQ ID NO: 212107 - DNA, 25 bp, E. coli
ggtatataaacccaaagacattgtc

SEQ ID NO: 212108 - DNA, 25 bp, E. coli
ggtatataaaccgaaagacattgtc

SEQ ID NO: 212109 - DNA, 25 bp, E. coli
taaggtgattataaccgaaggcgcg

SEQ ID NO: 212110 - DNA, 25 bp, E. coli
taaggtgattattaccgaaggcgcg

SEQ ID NO: 212111 - DNA, 25 bp, E. coli
aacgtggcatcgctcaattcattca

SEQ ID NO: 212112 - DNA, 25 bp, E. coli
catttgacttatacttgcctgggca

SEQ ID NO: 212113 - DNA, 25 bp, E. coli
catttgacttattcttgcctgggca

SEQ ID NO: 212114 - DNA, 25 bp, E. coli
agtgtcactcttaagctagccttgc

SEQ ID NO: 212115 - DNA, 25 bp, E. coli
agtgtcactctttagctagccttgc

SEQ ID NO: 212116 - DNA, 25 bp, E. coli
aacgtggcatcggtcaattcattca

SEQ ID NO: 212117 - DNA, 25 bp, E. coli
gcctgggcaataatatcccctgcaa

SEQ ID NO: 212118 - DNA, 25 bp, E. coli
ccagggcaactattgtgaaaagtac

SEQ ID NO: 212119 - DNA, 25 bp, E. coli
gcctgggcaatattatcccctgcaa

SEQ ID NO: 212120 - DNA, 25 bp, E. coli
ccagggcaactaatgtgaaaagtac

SEQ ID NO: 212121 - DNA, 25 bp, E. coli
gcattgaacaaaacttgaaccgatt

SEQ ID NO: 212122 - DNA, 25 bp, E. coli
gctagccttgcaacgcattgaacaa

SEQ ID NO: 212123 - DNA, 25 bp, E. coli
gcattgaacaaatcttgaaccgatt

SEQ ID NO: 212124 - DNA, 25 bp, E. coli
gctagccttgcatcgcattgaacaa

SEQ ID NO: 212125 - DNA, 25 bp, E. coli
gaaccgatttagcaaaacgtggcat

SEQ ID NO: 212126 - DNA, 25 bp, E. coli
gcaactaattacatgccagggcaac

SEQ ID NO: 212127 - DNA, 25 bp, E. coli
gcaactaattacttgccagggcaac

SEQ ID NO: 212128 - DNA, 25 bp, E. coli
gaaccgatttaggaaaacgtggcat

SEQ ID NO: 212129 - DNA, 25 bp, E. coli
ctgtgtatctgggttatcagcgaaa

SEQ ID NO: 212130 - DNA, 25 bp, E. coli
ctgtgtatctggcttatcagcgaaa

SEQ ID NO: 212131 - DNA, 25 bp, E. coli
ggtaaacaaggataaagtgtcactc

SEQ ID NO: 212132 - DNA, 25 bp, E. coli
ggtaaacaaggaaaaagtgtcactc

SEQ ID NO: 212133 - DNA, 25 bp, E. coli
ttcatggcctggacgatataccgcg

SEQ ID NO: 212134 - DNA, 25 bp, E. coli
ttcatggcctggtcgatataccgcg

SEQ ID NO: 212135 - DNA, 25 bp, E. coli
tctgtaaatcctatggcgtaccggt

SEQ ID NO: 212136 - DNA, 25 bp, E. coli
tctgtaaatcctttggcgtaccggt

SEQ ID NO: 212137 - DNA, 25 bp, E. coli
gaaaaacgggtaatagcgggcgcat

SEQ ID NO: 212138 - DNA, 25 bp, E. coli
gaaaaacgggtattagcgggcgcat

SEQ ID NO: 212139 - DNA, 25 bp, E. coli
ccgtcgaggaagatgtgtatagcaa

SEQ ID NO: 212140 - DNA, 25 bp, E. coli
ccgtcgaggaagttgtgtatagcaa

SEQ ID NO: 212141 - DNA, 25 bp, E. coli
gatcacgtcagccaagccgattgca

SEQ ID NO: 212142 - DNA, 25 bp, E. coli
gatcacgtcagcgaagccgattgca

SEQ ID NO: 212143 - DNA, 25 bp, E. coli
gatctgcgcaaaccgtttatcaccg

SEQ ID NO: 212144 - DNA, 25 bp, E. coli
tggcatcagcaaaaaacgccgtcga

SEQ ID NO: 212145 - DNA, 25 bp, E. coli
tggcatcagcaataaacgccgtcga

SEQ ID NO: 212146 - DNA, 25 bp, E. coli
taatcacaacgaggcgaatctggca

SEQ ID NO: 212147 - DNA, 25 bp, E. coli
taatggacggatactgctcgaccgc

SEQ ID NO: 212148 - DNA, 25 bp, E. coli
taatggacggattctgctcgaccgc

SEQ ID NO: 212149 - DNA, 25 bp, E. coli
taatcacaacgacgcgaatctggca

SEQ ID NO: 212150 - DNA, 25 bp, E. coli
gacggtgccgcattctcttttgaag

SEQ ID NO: 212151 - DNA, 25 bp, E. coli
gacggtgccgcaatctcttttgaag

SEQ ID NO: 212152 - DNA, 25 bp, E. coli
gatctgcgcaaagcgtttatcaccg

SEQ ID NO: 212153 - DNA, 25 bp, E. coli
gagaatatcgctatcacccaggaag

SEQ ID NO: 212154 - DNA, 25 bp, E. coli
gagaatatcgctttcacccaggaag

SEQ ID NO: 212155 - DNA, 25 bp, E. coli
acttcatctcaaaagtggctttacg

SEQ ID NO: 212156 - DNA, 25 bp, E. coli
acttcatctcaatagtggctttacg

SEQ ID NO: 212157 - DNA, 25 bp, E. coli
tgggacttcatcacaatagtggctt

SEQ ID NO: 212158 - DNA, 25 bp, E. coli
tgggacttcatctcaatagtggctt

SEQ ID NO: 212159 - DNA, 25 bp, E. coli
tccgctgggactacatctcaatagt

SEQ ID NO: 212160 - DNA, 25 bp, E. coli
tccgctgggacttcatctcaatagt

SEQ ID NO: 212161 - DNA, 25 bp, E. coli
tcagattttccgctactacacttca

SEQ ID NO: 212162 - DNA, 25 bp, E. coli
tcagattttccggtactacacttca

SEQ ID NO: 212163 - DNA, 25 bp, E. coli
ccacatcgatctcggcggcggtagt

SEQ ID NO: 212164 - DNA, 25 bp, E. coli
ccacatcgatctgggcggcggtagt

SEQ ID NO: 212165 - DNA, 25 bp, E. coli
gcggcggtagtcagattttccgcta

SEQ ID NO: 212166 - DNA, 25 bp, E. coli
gcggcggtagtctgattttccgcta

SEQ ID NO: 212167 - DNA, 25 bp, E. coli
gcggtagtcagattttccgctacta

SEQ ID NO: 212168 - DNA, 25 bp, E. coli
gcggtagtcagaatttccgctacta

SEQ ID NO: 212169 - DNA, 25 bp, E. coli
cgctgggacttcatctcaatagtgg

SEQ ID NO: 212170 - DNA, 25 bp, E. coli
cgctgggacttcttctcaatagtgg

SEQ ID NO: 212171 - DNA, 25 bp, E. coli
ctactacacttctggcgatgagttt

SEQ ID NO: 212172 - DNA, 25 bp, E. coli
ctactacacttcaggcgatgagttt

SEQ ID NO: 212173 - DNA, 25 bp, E. coli
ggtccgctgggagttcatctcaata

SEQ ID NO: 212174 - DNA, 25 bp, E. coli
gtcagccacatcgatctgggcggcg

SEQ ID NO: 212175 - DNA, 25 bp, E. coli
gtcagccacatccatctgggcggcg

SEQ ID NO: 212176 - DNA, 25 bp, E. coli
ggtccgctgggacttcatctcaata

SEQ ID NO: 212177 - DNA, 25 bp, E. coli
gacttaattggctacaccccgtggg

SEQ ID NO: 212178 - DNA, 25 bp, E. coli
gacttaattggcaacaccccgtggg

SEQ ID NO: 212179 - DNA, 25 bp, E. coli
tatgagttagttgccagtgccctgg

SEQ ID NO: 212180 - DNA, 25 bp, E. coli
tatgagttagttcccagtgccctgg

SEQ ID NO: 212181 - DNA, 25 bp, E. coli
tgatgatggccaggaaagcgatgca

SEQ ID NO: 212182 - DNA, 25 bp, E. coli
tgatgatggccacgaaagcgatgca

SEQ ID NO: 212183 - DNA, 25 bp, E. coli
tcgggatctcatggccaacaatggc

SEQ ID NO: 212184 - DNA, 25 bp, E. coli
tcgggatctcatcgccaacaatggc

SEQ ID NO: 212185 - DNA, 25 bp, E. coli
gaatctttccgcaaggtgacgaaca

SEQ ID NO: 212186 - DNA, 25 bp, E. coli
gaatctttccgctaggtgacgaaca

SEQ ID NO: 212187 - DNA, 25 bp, E. coli
gacaaaatatggaggctggcgaaac

SEQ ID NO: 212188 - DNA, 25 bp, E. coli
gacaaaatatggtggctggcgaaac

SEQ ID NO: 212189 - DNA, 25 bp, E. coli
ccctggcggtactgactggaaaact

SEQ ID NO: 212190 - DNA, 25 bp, E. coli
cattgacctggtttctgccggaaca

SEQ ID NO: 212191 - DNA, 25 bp, E. coli
ccctggcggtacagactggaaaact

SEQ ID NO: 212192 - DNA, 25 bp, E. coli
cattgacctggtatctgccggaaca

SEQ ID NO: 212193 - DNA, 25 bp, E. coli
gatgataacgcgattcttgccagag

SEQ ID NO: 212194 - DNA, 25 bp, E. coli
gatgtaatgactgctggcgctcacg

SEQ ID NO: 212195 - DNA, 25 bp, E. coli
gatgataacgcgtttcttgccagag

SEQ ID NO: 212196 - DNA, 25 bp, E. coli
gacgtgtgcaccgaacgatatgatg

SEQ ID NO: 212197 - DNA, 25 bp, E. coli
gacgtgtgcacccaacgatatgatg

SEQ ID NO: 212198 - DNA, 25 bp, E. coli
gatgtaatgactcctggcgctcacg

SEQ ID NO: 212199 - DNA, 25 bp, E. coli
caaggaagcatctccgcaggttgtg

SEQ ID NO: 212200 - DNA, 25 bp, E. coli
caaggaagcatcaccgcaggttgtg

SEQ ID NO: 212201 - DNA, 25 bp, E. coli
caaaaacctccgaagcatctggaag

SEQ ID NO: 212202 - DNA, 25 bp, E. coli
caaaaacctccgtagcatctggaag

SEQ ID NO: 212203 - DNA, 25 bp, E. coli
catgcaatcacgtatagctaaggga

SEQ ID NO: 212204 - DNA, 25 bp, E. coli
catgcaatcacgaatagctaaggga

SEQ ID NO: 212205 - DNA, 25 bp, E. coli
taacgggagaactacaaggaagcat

SEQ ID NO: 212206 - DNA, 25 bp, E. coli
tacttgctgctgctggcgtatacaa

SEQ ID NO: 212207 - DNA, 25 bp, E. coli
tacttgctgctggtggcgtatacaa

SEQ ID NO: 212208 - DNA, 25 bp, E. coli
agatactgcggaaaaactgggtgga

SEQ ID NO: 212209 - DNA, 25 bp, E. coli
agatactgcggataaactgggtgga

SEQ ID NO: 212210 - DNA, 25 bp, E. coli
aacagcgggcatagcgatagcaaca

SEQ ID NO: 212211 - DNA, 25 bp, E. coli
aacagcgggcattgcgatagcaaca

SEQ ID NO: 212212 - DNA, 25 bp, E. coli
tattatatacaactaagaggcgctt

SEQ ID NO: 212213 - DNA, 25 bp, E. coli
tattatatacaagtaagaggcgctt

SEQ ID NO: 212214 - DNA, 25 bp, E. coli
tgaaagcaaaatgactccctgggcc

SEQ ID NO: 212215 - DNA, 25 bp, E. coli
tgaaagcaaaatcactccctgggcc

SEQ ID NO: 212216 - DNA, 25 bp, E. coli
tggaagattcaaggccgaagacctt

SEQ ID NO: 212217 - DNA, 25 bp, E. coli
tggaagattcaacgccgaagacctt

SEQ ID NO: 212218 - DNA, 25 bp, E. coli
taacgggagaacaacaaggaagcat

SEQ ID NO: 212219 - DNA, 25 bp, E. coli
gagttcagctatatggcactccctg

SEQ ID NO: 212220 - DNA, 25 bp, E. coli
gagttcagctatttggcactccctg

SEQ ID NO: 212221 - DNA, 25 bp, E. coli
aattaaacagtcgatctccgaggcc

SEQ ID NO: 212222 - DNA, 25 bp, E. coli
aattaaacagtccatctccgaggcc

SEQ ID NO: 212223 - DNA, 25 bp, E. coli
aacgtggaagtcgtatacatccgcc

SEQ ID NO: 212224 - DNA, 25 bp, E. coli
aacgtggaagtcctatacatccgcc

SEQ ID NO: 212225 - DNA, 25 bp, E. coli
tattgaccggcgactgaacggcaaa

SEQ ID NO: 212226 - DNA, 25 bp, E. coli
tattgaccggcgtctgaacggcaaa

SEQ ID NO: 212227 - DNA, 25 bp, E. coli
tgttttgcctgatggacgtttccgg

SEQ ID NO: 212228 - DNA, 25 bp, E. coli
tgttttgcctgaaggacgtttccgg

SEQ ID NO: 212229 - DNA, 25 bp, E. coli
tcatgcactggaagagaatttggcc

SEQ ID NO: 212230 - DNA, 25 bp, E. coli
tcatgcactggatgagaatttggcc

SEQ ID NO: 212231 - DNA, 25 bp, E. coli
tcatacccaggcgaaagaagtcgat

SEQ ID NO: 212232 - DNA, 25 bp, E. coli
tcatacccaggccaaagaagtcgat

SEQ ID NO: 212233 - DNA, 25 bp, E. coli
gaatataaaacgcatcgggcgggtt

SEQ ID NO: 212234 - DNA, 25 bp, E. coli
gaatataaaacggatcgggcgggtt

SEQ ID NO: 212235 - DNA, 25 bp, E. coli
gaaagagcgttataacccggcacag

SEQ ID NO: 212236 - DNA, 25 bp, E. coli
gaaagagcgttaaaacccggcacag

SEQ ID NO: 212237 - DNA, 25 bp, E. coli
ggcgttccggccaatatcagcgttg

SEQ ID NO: 212238 - DNA, 25 bp, E. coli
ggcgttccggcctatatcagcgttg

SEQ ID NO: 212239 - DNA, 25 bp, E. coli
taagcgttcggtgactgacgtcgac

SEQ ID NO: 212240 - DNA, 25 bp, E. coli
taagcgttcggtcactgacgtcgac

SEQ ID NO: 212241 - DNA, 25 bp, E. coli
gatgactctccggtttgccatgaaa

SEQ ID NO: 212242 - DNA, 25 bp, E. coli
gatgactctccgctttgccatgaaa

SEQ ID NO: 212243 - DNA, 25 bp, E. coli
agcacgacggttattacgagaccgt

SEQ ID NO: 212244 - DNA, 25 bp, E. coli
agcacgacggtttttacgagaccgt

SEQ ID NO: 212245 - DNA, 25 bp, E. coli
aaaggcacccagcacgacggttatt

SEQ ID NO: 212246 - DNA, 25 bp, E. coli
aaaggcacccaggacgacggttatt

SEQ ID NO: 212247 - DNA, 25 bp, E. coli
caaacttaccgacaaaggcacccag

SEQ ID NO: 212248 - DNA, 25 bp, E. coli
caaacttaccgagaaaggcacccag

SEQ ID NO: 212249 - DNA, 25 bp, E. coli
tattgatggcctccccgcagctcgt

SEQ ID NO: 212250 - DNA, 25 bp, E. coli
tattgatggcctgcccgcagctcgt

SEQ ID NO: 212251 - DNA, 25 bp, E. coli
tttattgatggcgtccccgcagctc

SEQ ID NO: 212252 - DNA, 25 bp, E. coli
tttattgatggcctccccgcagctc

SEQ ID NO: 212253 - DNA, 25 bp, E. coli
tcgtcaggaggaaccgctgacgccg

SEQ ID NO: 212254 - DNA, 25 bp, E. coli
tcgtcaggaggatccgctgacgccg

SEQ ID NO: 212255 - DNA, 25 bp, E. coli
gccgggtcatcctccgtttttattg

SEQ ID NO: 212256 - DNA, 25 bp, E. coli
gccgggtcatccaccgtttttattg

SEQ ID NO: 212257 - DNA, 25 bp, E. coli
gcagctcgtcagcaggatccgctga

SEQ ID NO: 212258 - DNA, 25 bp, E. coli
gcagctcgtcaggaggatccgctga

SEQ ID NO: 212259 - DNA, 25 bp, E. coli
cccagcacgacggttattacgagac

SEQ ID NO: 212260 - DNA, 25 bp, E. coli
cccagcacgacgcttattacgagac

SEQ ID NO: 212261 - DNA, 25 bp, E. coli
gttattacgagagcgtcatcaccgc

SEQ ID NO: 212262 - DNA, 25 bp, E. coli
gttattacgagaccgtcatcaccgc

SEQ ID NO: 212263 - DNA, 25 bp, E. coli
ggcacccagcacgacggttattacg

SEQ ID NO: 212264 - DNA, 25 bp, E. coli
ggcacccagcaccacggttattacg

SEQ ID NO: 212265 - DNA, 25 bp, E. coli
caatcgacggtaaaggtccgctgga

SEQ ID NO: 212266 - DNA, 25 bp, E. coli
caatcgacggtataggtccgctgga

SEQ ID NO: 212267 - DNA, 25 bp, E. coli
tatcccgtgttggtggtgcagcaca

SEQ ID NO: 212268 - DNA, 25 bp, E. coli
tatcccgtgttgctggtgcagcaca

SEQ ID NO: 212269 - DNA, 25 bp, E. coli
tataaagccgttcactccatgatcc

SEQ ID NO: 212270 - DNA, 25 bp, E. coli
tataaagccgttgactccatgatcc

SEQ ID NO: 212271 - DNA, 25 bp, E. coli
tgtagaagcaatggctccgggcgtt

SEQ ID NO: 212272 - DNA, 25 bp, E. coli
tgtagaagcaatcgctccgggcgtt

SEQ ID NO: 212273 - DNA, 25 bp, E. coli
tgaaaaaactgtgcggtggtatccg

SEQ ID NO: 212274 - DNA, 25 bp, E. coli
tgaaaaaactgtccggtggtatccg

SEQ ID NO: 212275 - DNA, 25 bp, E. coli
tccgtgaccgcggtgaagatgcgct

SEQ ID NO: 212276 - DNA, 25 bp, E. coli
tccgtgaccgcgctgaagatgcgct

SEQ ID NO: 212277 - DNA, 25 bp, E. coli
gaacgtcagtccctagatcagccgg

SEQ ID NO: 212278 - DNA, 25 bp, E. coli
gaaacagaaacactatgcgccgatg

SEQ ID NO: 212279 - DNA, 25 bp, E. coli
gaaacagaaacagtatgcgccgatg

SEQ ID NO: 212280 - DNA, 25 bp, E. coli
gaacgtcagtccgtagatcagccgg

SEQ ID NO: 212281 - DNA, 25 bp, E. coli
tggaaaccaacctgttcaacgccgg

SEQ ID NO: 212282 - DNA, 25 bp, E. coli
ggtgaaatgatcaccctgccgggta

SEQ ID NO: 212283 - DNA, 25 bp, E. coli
ggtgaaatgatctccctgccgggta

SEQ ID NO: 212284 - DNA, 25 bp, E. coli
tggaaaccaaccagttcaacgccgg

SEQ ID NO: 212285 - DNA, 25 bp, E. coli
gatgcaagagatgaaccagaccggt

SEQ ID NO: 212286 - DNA, 25 bp, E. coli
gatgcaagagatcaaccagaccggt

SEQ ID NO: 212287 - DNA, 25 bp, E. coli
aagaatccgcattccaggaagggcg

SEQ ID NO: 212288 - DNA, 25 bp, E. coli
aagaatccgcataccaggaagggcg

SEQ ID NO: 212289 - DNA, 25 bp, E. coli
accaggaagggccctgggaaacact

SEQ ID NO: 212290 - DNA, 25 bp, E. coli
atccgcataccaggaagggcgctgg

SEQ ID NO: 212291 - DNA, 25 bp, E. coli
accaggaagggcgctgggaaacact

SEQ ID NO: 212292 - DNA, 25 bp, E. coli
atccgcataccacgaagggcgctgg

SEQ ID NO: 212293 - DNA, 25 bp, E. coli
aaatgctgctggctgtttatgccta

SEQ ID NO: 212294 - DNA, 25 bp, E. coli
aaatgctgctgggtgtttatgccta

SEQ ID NO: 212295 - DNA, 25 bp, E. coli
ttactatctcccgaaagaatccgca

SEQ ID NO: 212296 - DNA, 25 bp, E. coli
ttactatctccccaaagaatccgca

SEQ ID NO: 212297 - DNA, 25 bp, E. coli
tgaatgtggtgaagtctgcccgtgt

SEQ ID NO: 212298 - DNA, 25 bp, E. coli
tgaatgtggtgatgtctgcccgtgt

SEQ ID NO: 212299 - DNA, 25 bp, E. coli
tgctgctgggtgtttatgcctactt

SEQ ID NO: 212300 - DNA, 25 bp, E. coli
tgctgctgggtgattatgcctactt

SEQ ID NO: 212301 - DNA, 25 bp, E. coli
tcccgaaagaatccgcataccagga

SEQ ID NO: 212302 - DNA, 25 bp, E. coli
tcccgaaagaatgcgcataccagga

SEQ ID NO: 212303 - DNA, 25 bp, E. coli
tctcccgaaagaatccgcataccag

SEQ ID NO: 212304 - DNA, 25 bp, E. coli
tctcccgaaagattccgcataccag

SEQ ID NO: 212305 - DNA, 25 bp, E. coli
gaatccgcatacgaggaagggcgct

SEQ ID NO: 212306 - DNA, 25 bp, E. coli
gaatccgcataccaggaagggcgct

SEQ ID NO: 212307 - DNA, 25 bp, E. coli
gaaagaatccgcataccaggaaggg

SEQ ID NO: 212308 - DNA, 25 bp, E. coli
gaaagaatccgcttaccaggaaggg

SEQ ID NO: 212309 - DNA, 25 bp, E. coli
catctgttttctctgctggcgcagc

SEQ ID NO: 212310 - DNA, 25 bp, E. coli
catctgttttctgtgctggcgcagc

SEQ ID NO: 212311 - DNA, 25 bp, E. coli
caggtgccagttgttcaggctgacg

SEQ ID NO: 212312 - DNA, 25 bp, E. coli
caggtgccagttcttcaggctgacg

SEQ ID NO: 212313 - DNA, 25 bp, E. coli
tgacggatggattgtaaaccagaac

SEQ ID NO: 212314 - DNA, 25 bp, E. coli
tgacggatggatagtaaaccagaac

SEQ ID NO: 212315 - DNA, 25 bp, E. coli
tgccagttgttcaggctgacggatg

SEQ ID NO: 212316 - DNA, 25 bp, E. coli
tgccagttgttctggctgacggatg

SEQ ID NO: 212317 - DNA, 25 bp, E. coli
tctgctggcgcagcaggtgccagtt

SEQ ID NO: 212318 - DNA, 25 bp, E. coli
tcaggctgacggttggattgtaaac

SEQ ID NO: 212319 - DNA, 25 bp, E. coli
tcaggctgacggatggattgtaaac

SEQ ID NO: 212320 - DNA, 25 bp, E. coli
tctgctggcgcaccaggtgccagtt

SEQ ID NO: 212321 - DNA, 25 bp, E. coli
gcagcaggtgccagttgttcaggct

SEQ ID NO: 212322 - DNA, 25 bp, E. coli
gcagcaggtgcctgttgttcaggct

SEQ ID NO: 212323 - DNA, 25 bp, E. coli
cgtgcgccatctcttttctctgctg

SEQ ID NO: 212324 - DNA, 25 bp, E. coli
cgtgcgccatctgttttctctgctg

SEQ ID NO: 212325 - DNA, 25 bp, E. coli
gattgtaaaccagaacgaccagaaa

SEQ ID NO: 212326 - DNA, 25 bp, E. coli
gattgtaaaccacaacgaccagaaa

SEQ ID NO: 212327 - DNA, 25 bp, E. coli
ggtatcgtgcgcgatctgttttctc

SEQ ID NO: 212328 - DNA, 25 bp, E. coli
ggtatcgtgcgccatctgttttctc

SEQ ID NO: 212329 - DNA, 25 bp, E. coli
gatggattgtaaaccagaacgacca

SEQ ID NO: 212330 - DNA, 25 bp, E. coli
gatggattgtaatccagaacgacca

SEQ ID NO: 212331 - DNA, 25 bp, E. coli
aaattattatttctgcgctacgcga

SEQ ID NO: 212332 - DNA, 25 bp, E. coli
aaattattatttgtgcgctacgcga

SEQ ID NO: 212333 - DNA, 25 bp, E. coli
tatcgccatggtgctggtaaccgag

SEQ ID NO: 212334 - DNA, 25 bp, E. coli
tttgtggctgcggtactgactctgt

SEQ ID NO: 212335 - DNA, 25 bp, E. coli
tatcgccatggtcctggtaaccgag

SEQ ID NO: 212336 - DNA, 25 bp, E. coli
tttgtggctgcgctactgactctgt

SEQ ID NO: 212337 - DNA, 25 bp, E. coli
tgcaatatttgaccgctgcgcgtgc

SEQ ID NO: 212338 - DNA, 25 bp, E. coli
tgcaatatttgagcgctgcgcgtgc

SEQ ID NO: 212339 - DNA, 25 bp, E. coli
gctgctgtggcgtccgaacatttgg

SEQ ID NO: 212340 - DNA, 25 bp, E. coli
gctggaaccagagtacccggtttgg

SEQ ID NO: 212341 - DNA, 25 bp, E. coli
gctggaaccagactacccggtttgg

SEQ ID NO: 212342 - DNA, 25 bp, E. coli
gctgctgtggcgaccgaacatttgg

SEQ ID NO: 212343 - DNA, 25 bp, E. coli
gaacatttgggtagagtacgccggt

SEQ ID NO: 212344 - DNA, 25 bp, E. coli
gattgggaaagtgaaaaccactgcc

SEQ ID NO: 212345 - DNA, 25 bp, E. coli
gattgggaaagtcaaaaccactgcc

SEQ ID NO: 212346 - DNA, 25 bp, E. coli
gaacatttgggttgagtacgccggt

SEQ ID NO: 212347 - DNA, 25 bp, E. coli
cgatgatcgcccctgaaattattat

SEQ ID NO: 212348 - DNA, 25 bp, E. coli
cgatgatcgcccgtgaaattattat

SEQ ID NO: 212349 - DNA, 25 bp, E. coli
gataaagttctcgtggctatcgcca

SEQ ID NO: 212350 - DNA, 25 bp, E. coli
gataaagttctcctggctatcgcca

SEQ ID NO: 212351 - DNA, 25 bp, E. coli
taatatccctaccttgcttacactg

SEQ ID NO: 212352 - DNA, 25 bp, E. coli
taatatccctacgttgcttacactg

SEQ ID NO: 212353 - DNA, 25 bp, E. coli
caatatcggcgaacggttgatggca

SEQ ID NO: 212354 - DNA, 25 bp, E. coli
caatatcggcgatcggttgatggca

SEQ ID NO: 212355 - DNA, 25 bp, E. coli
caccatccgtattcccagttgctgg

SEQ ID NO: 212356 - DNA, 25 bp, E. coli
caccatccgtatacccagttgctgg

SEQ ID NO: 212357 - DNA, 25 bp, E. coli
atgccccgggcaaaggcttcagcga

SEQ ID NO: 212358 - DNA, 25 bp, E. coli
atgccccgggcataggcttcagcga

SEQ ID NO: 212359 - DNA, 25 bp, E. coli
tatcggcgaacggttgatggcaacc

SEQ ID NO: 212360 - DNA, 25 bp, E. coli
tatcggcgaacgcttgatggcaacc

SEQ ID NO: 212361 - DNA, 25 bp, E. coli
ttgatggcaacccgagcgcgtcatt

SEQ ID NO: 212362 - DNA, 25 bp, E. coli
ttgatggcaaccggagcgcgtcatt

SEQ ID NO: 212363 - DNA, 25 bp, E. coli
tgtgtcggtacacgcgcgcctgctg

SEQ ID NO: 212364 - DNA, 25 bp, E. coli
tgtgtcggtacaggcgcgcctgctg

SEQ ID NO: 212365 - DNA, 25 bp, E. coli
tgctggacctgcaccgcggtctggt

SEQ ID NO: 212366 - DNA, 25 bp, E. coli
tgctggacctgctccgcggtctggt

SEQ ID NO: 212367 - DNA, 25 bp, E. coli
tctggtgatggaccttaacctggcg

SEQ ID NO: 212368 - DNA, 25 bp, E. coli
tctggtgatggagcttaacctggcg

SEQ ID NO: 212369 - DNA, 25 bp, E. coli
gccaaaagccaatgaatcaaccgtt

SEQ ID NO: 212370 - DNA, 25 bp, E. coli
gccaaaagccaaagaatcaaccgtt

SEQ ID NO: 212371 - DNA, 25 bp, E. coli
ccgcggtctggtgatggagcttaac

SEQ ID NO: 212372 - DNA, 25 bp, E. coli
cgtttgctggtaatgaagcaaggga

SEQ ID NO: 212373 - DNA, 25 bp, E. coli
cgtttgctggtattgaagcaaggga

SEQ ID NO: 212374 - DNA, 25 bp, E. coli
ccgcggtctggtcatggagcttaac

SEQ ID NO: 212375 - DNA, 25 bp, E. coli
cacagtatgcggagatgcgcgccat

SEQ ID NO: 212376 - DNA, 25 bp, E. coli
cagctggtgcgctagatgatgaaca

SEQ ID NO: 212377 - DNA, 25 bp, E. coli
cagctggtgcgcaagatgatgaaca

SEQ ID NO: 212378 - DNA, 25 bp, E. coli
cacagtatgcggtgatgcgcgccat

SEQ ID NO: 212379 - DNA, 25 bp, E. coli
taaagcgttccatcagttacgacag

SEQ ID NO: 212380 - DNA, 25 bp, E. coli
taaagcgttccaacagttacgacag

SEQ ID NO: 212381 - DNA, 25 bp, E. coli
agctttttcagctgcacacggctcg

SEQ ID NO: 212382 - DNA, 25 bp, E. coli
agctttttcagcagcacacggctcg

SEQ ID NO: 212383 - DNA, 25 bp, E. coli
tagtcagacgtgtacatgatgccgc

SEQ ID NO: 212384 - DNA, 25 bp, E. coli
tagtcagacgtgaacatgatgccgc

SEQ ID NO: 212385 - DNA, 25 bp, E. coli
cctggtatcgaacaggtggcactga

SEQ ID NO: 212386 - DNA, 25 bp, E. coli
cctggtatcgaagaggtggcactga

SEQ ID NO: 212387 - DNA, 25 bp, E. coli
gcgccattgctgttaagcctggtat

SEQ ID NO: 212388 - DNA, 25 bp, E. coli
gcgccattgctgataagcctggtat

SEQ ID NO: 212389 - DNA, 25 bp, E. coli
gcacgagttacctgacctgaccaaa

SEQ ID NO: 212390 - DNA, 25 bp, E. coli
gcacgagttaccagacctgaccaaa

SEQ ID NO: 212391 - DNA, 25 bp, E. coli
gaaaagatacttgctgcggcgatac

SEQ ID NO: 212392 - DNA, 25 bp, E. coli
gaaaagatacttcctgcggcgatac

SEQ ID NO: 212393 - DNA, 25 bp, E. coli
cgataccgattggtgacagcgtgga

SEQ ID NO: 212394 - DNA, 25 bp, E. coli
cgataccgattgctgacagcgtgga

SEQ ID NO: 212395 - DNA, 25 bp, E. coli
gatagaagcagctgtcagcaccaaa

SEQ ID NO: 212396 - DNA, 25 bp, E. coli
gatagaagcagcagtcagcaccaaa

SEQ ID NO: 212397 - DNA, 25 bp, E. coli
caactggacagtctgcttgccgaac

SEQ ID NO: 212398 - DNA, 25 bp, E. coli
cacacaacagcaactggacagtctg

SEQ ID NO: 212399 - DNA, 25 bp, E. coli
caactggacagtgtgcttgccgaac

SEQ ID NO: 212400 - DNA, 25 bp, E. coli
cacacaacagcatctggacagtctg

SEQ ID NO: 212401 - DNA, 25 bp, E. coli
atgcgccgctcttcctgccactggg

SEQ ID NO: 212402 - DNA, 25 bp, E. coli
actgcttctcgtgcgcgcaaagcgt

SEQ ID NO: 212403 - DNA, 25 bp, E. coli
atgcgccgctctacctgccactggg

SEQ ID NO: 212404 - DNA, 25 bp, E. coli
actgcttctcgtccgcgcaaagcgt

SEQ ID NO: 212405 - DNA, 25 bp, E. coli
aaagctttgccgtcccactgcagct

SEQ ID NO: 212406 - DNA, 25 bp, E. coli
aaagctttgccgacccactgcagct

SEQ ID NO: 212407 - DNA, 25 bp, E. coli
cgacagcatcaaccacaggcggcaa

SEQ ID NO: 212408 - DNA, 25 bp, E. coli
cgacagcatcaagcacaggcggcaa

SEQ ID NO: 212409 - DNA, 25 bp, E. coli
ctggctcgcccgagtacgacagcat

SEQ ID NO: 212410 - DNA, 25 bp, E. coli
ctggctcgcccgtgtacgacagcat

SEQ ID NO: 212411 - DNA, 25 bp, E. coli
gtctgcttgccgtacagcctggcgt

SEQ ID NO: 212412 - DNA, 25 bp, E. coli
gtctgcttgccgaacagcctggcgt

SEQ ID NO: 212413 - DNA, 25 bp, E. coli
gtgtacgacagcatcaaccacaggc

SEQ ID NO: 212414 - DNA, 25 bp, E. coli
gtgtacgacagcttcaaccacaggc

SEQ ID NO: 212415 - DNA, 25 bp, E. coli
tggctcactgctactcgtgcgcgca

SEQ ID NO: 212416 - DNA, 25 bp, E. coli
tggacagtctgcatgccgaacagcc

SEQ ID NO: 212417 - DNA, 25 bp, E. coli
tggacagtctgcttgccgaacagcc

SEQ ID NO: 212418 - DNA, 25 bp, E. coli
tggctcactgcttctcgtgcgcgca

SEQ ID NO: 212419 - DNA, 25 bp, E. coli
cattaattggtaccaaggttgccgc

SEQ ID NO: 212420 - DNA, 25 bp, E. coli
cattaattggtagcaaggttgccgc

SEQ ID NO: 212421 - DNA, 25 bp, E. coli
agtttgaggcacaggagcgtccaca

SEQ ID NO: 212422 - DNA, 25 bp, E. coli
agtttgaggcactggagcgtccaca

SEQ ID NO: 212423 - DNA, 25 bp, E. coli
aacaatgtcggcaggctgtgctggc

SEQ ID NO: 212424 - DNA, 25 bp, E. coli
aacaatgtcggctggctgtgctggc

SEQ ID NO: 212425 - DNA, 25 bp, E. coli
tagataaaatgtggcagggtattcc

SEQ ID NO: 212426 - DNA, 25 bp, E. coli
tatgtgcgaaagtgggcagcgcctc

SEQ ID NO: 212427 - DNA, 25 bp, E. coli
tatgtgcgaaagagggcagcgcctc

SEQ ID NO: 212428 - DNA, 25 bp, E. coli
tagataaaatgtcgcagggtattcc

SEQ ID NO: 212429 - DNA, 25 bp, E. coli
tattctcgcgcgtatgcagcgtcgg

SEQ ID NO: 212430 - DNA, 25 bp, E. coli
tattctcgcgcgaatgcagcgtcgg

SEQ ID NO: 212431 - DNA, 25 bp, E. coli
tgatattttacgcaagggtagcccc

SEQ ID NO: 212432 - DNA, 25 bp, E. coli
tgatattttacggaagggtagcccc

SEQ ID NO: 212433 - DNA, 25 bp, E. coli
tgaagatcgactaccctggctggaa

SEQ ID NO: 212434 - DNA, 25 bp, E. coli
tgaagatcgacttccctggctggaa

SEQ ID NO: 212435 - DNA, 25 bp, E. coli
tcatttcctctggttagatggcgac

SEQ ID NO: 212436 - DNA, 25 bp, E. coli
tcatttcctctgcttagatggcgac

SEQ ID NO: 212437 - DNA, 25 bp, E. coli
gctgtgctggcgatacgacaaaaca

SEQ ID NO: 212438 - DNA, 25 bp, E. coli
gctgtgctggcgttacgacaaaaca

SEQ ID NO: 212439 - DNA, 25 bp, E. coli
ggtgacgatcttgatccagccaaaa

SEQ ID NO: 212440 - DNA, 25 bp, E. coli
ggtgacgatcttcatccagccaaaa

SEQ ID NO: 212441 - DNA, 25 bp, E. coli
ccggaagatgatgcccgcacggtta

SEQ ID NO: 212442 - DNA, 25 bp, E. coli
gcccgcacggtttatggcgtcattc

SEQ ID NO: 212443 - DNA, 25 bp, E. coli
ccggaagatgatccccgcacggtta

SEQ ID NO: 212444 - DNA, 25 bp, E. coli
gcccgcacggttaatggcgtcattc

SEQ ID NO: 212445 - DNA, 25 bp, E. coli
gctggtgacggttgaagatattctg

SEQ ID NO: 212446 - DNA, 25 bp, E. coli
gctggtgacggtagaagatattctg

SEQ ID NO: 212447 - DNA, 25 bp, E. coli
gcgtcattcttgaggcactggaaga

SEQ ID NO: 212448 - DNA, 25 bp, E. coli
gcgtcattcttgtggcactggaaga

SEQ ID NO: 212449 - DNA, 25 bp, E. coli
cgcacggttaatcgcgtcattcttg

SEQ ID NO: 212450 - DNA, 25 bp, E. coli
cgcacggttaatggcgtcattcttg

SEQ ID NO: 212451 - DNA, 25 bp, E. coli
cattcttgaggcactggaagagatc

SEQ ID NO: 212452 - DNA, 25 bp, E. coli
cattcttgaggctctggaagagatc

SEQ ID NO: 212453 - DNA, 25 bp, E. coli
cggttaatggcgacattcttgaggc

SEQ ID NO: 212454 - DNA, 25 bp, E. coli
cggttaatggcgtcattcttgaggc

SEQ ID NO: 212455 - DNA, 25 bp, E. coli
tggcgtcattctagaggcactggaa

SEQ ID NO: 212456 - DNA, 25 bp, E. coli
tggcgtcattcttgaggcactggaa

SEQ ID NO: 212457 - DNA, 25 bp, E. coli
taatggcgtcattcttgaggcactg

SEQ ID NO: 212458 - DNA, 25 bp, E. coli
taatggcgtcatacttgaggcactg

SEQ ID NO: 212459 - DNA, 25 bp, E. coli
gatgatgcccgctcggttaatggcg

SEQ ID NO: 212460 - DNA, 25 bp, E. coli
gatgatgcccgcacggttaatggcg

SEQ ID NO: 212461 - DNA, 25 bp, E. coli
gatgcccgcacggttaatggcgtca

SEQ ID NO: 212462 - DNA, 25 bp, E. coli
gatgcccgcacgcttaatggcgtca

SEQ ID NO: 212463 - DNA, 25 bp, E. coli
caatacgtacgcttgagatcaggat

SEQ ID NO: 212464 - DNA, 25 bp, E. coli
caatacgtacgcatgagatcaggat

SEQ ID NO: 212465 - DNA, 25 bp, E. coli
caagtggtactaaaactggctgtta

SEQ ID NO: 212466 - DNA, 25 bp, E. coli
caagtggtactataactggctgtta

SEQ ID NO: 212467 - DNA, 25 bp, E. coli
cataccgcttgctctatatactgcg

SEQ ID NO: 212468 - DNA, 25 bp, E. coli
cagtcagctttatacaagcagcgtc

SEQ ID NO: 212469 - DNA, 25 bp, E. coli
cataccgcttgcactatatactgcg

SEQ ID NO: 212470 - DNA, 25 bp, E. coli
cagtcagctttaaacaagcagcgtc

SEQ ID NO: 212471 - DNA, 25 bp, E. coli
aactattaggtggagagatattcgc

SEQ ID NO: 212472 - DNA, 25 bp, E. coli
aactattaggtgcagagatattcgc

SEQ ID NO: 212473 - DNA, 25 bp, E. coli
tattccaataaatccagtcagcttt

SEQ ID NO: 212474 - DNA, 25 bp, E. coli
tattccaataaaaccagtcagcttt

SEQ ID NO: 212475 - DNA, 25 bp, E. coli
tatatactgcgggtaggaaaggcgc

SEQ ID NO: 212476 - DNA, 25 bp, E. coli
tatatactgcggctaggaaaggcgc

SEQ ID NO: 212477 - DNA, 25 bp, E. coli
cctctggaaataggacttgtgagca

SEQ ID NO: 212478 - DNA, 25 bp, E. coli
cctctggaaatacgacttgtgagca

SEQ ID NO: 212479 - DNA, 25 bp, E. coli
gaaaggcgcgcacagggaaatataa

SEQ ID NO: 212480 - DNA, 25 bp, E. coli
gaaaggcgcgcagagggaaatataa

SEQ ID NO: 212481 - DNA, 25 bp, E. coli
gtataacatcctagtgaaatctccc

SEQ ID NO: 212482 - DNA, 25 bp, E. coli
gtataacatccttgtgaaatctccc

SEQ ID NO: 212483 - DNA, 25 bp, E. coli
gagtcattaccgacaatacgtacgc

SEQ ID NO: 212484 - DNA, 25 bp, E. coli
gagtcattaccgtcaatacgtacgc

SEQ ID NO: 212485 - DNA, 25 bp, E. coli
aatgtggactacagccagatcccgg

SEQ ID NO: 212486 - DNA, 25 bp, E. coli
aatgtggactactgccagatcccgg

SEQ ID NO: 212487 - DNA, 25 bp, E. coli
caaagccagttacgacaatgtggac

SEQ ID NO: 212488 - DNA, 25 bp, E. coli
caaagccagttaggacaatgtggac

SEQ ID NO: 212489 - DNA, 25 bp, E. coli
caaatctgcgagttgtacagccgcg

SEQ ID NO: 212490 - DNA, 25 bp, E. coli
caaatctgcgagatgtacagccgcg

SEQ ID NO: 212491 - DNA, 25 bp, E. coli
tacacagaaaaaggcgaagacccgt

SEQ ID NO: 212492 - DNA, 25 bp, E. coli
tacacagaaaaacgcgaagacccgt

SEQ ID NO: 212493 - DNA, 25 bp, E. coli
aaaatgggatgacctttccctgcgc

SEQ ID NO: 212494 - DNA, 25 bp, E. coli
aaatcatcgcccagtacgagcaggc

SEQ ID NO: 212495 - DNA, 25 bp, E. coli
aaatcatcgccctgtacgagcaggc

SEQ ID NO: 212496 - DNA, 25 bp, E. coli
aaaatgggatgagctttccctgcgc

SEQ ID NO: 212497 - DNA, 25 bp, E. coli
ttctggtgccgttacgtgctcagcc

SEQ ID NO: 212498 - DNA, 25 bp, E. coli
ttctggtgccgtaacgtgctcagcc

SEQ ID NO: 212499 - DNA, 25 bp, E. coli
tgcaggatggtcctactcacaaaca

SEQ ID NO: 212500 - DNA, 25 bp, E. coli
tgcaggatggtcgtactcacaaaca

SEQ ID NO: 212501 - DNA, 25 bp, E. coli
gacagcctgggcaaacgaaattcgc

SEQ ID NO: 212502 - DNA, 25 bp, E. coli
gacagcctgggctaacgaaattcgc

SEQ ID NO: 212503 - DNA, 25 bp, E. coli
gacctgcgcacactggctctggaaa

SEQ ID NO: 212504 - DNA, 25 bp, E. coli
tgacggcgaggtcgttcgtcccaaa

SEQ ID NO: 212505 - DNA, 25 bp, E. coli
tgacggcgaggtggttcgtcccaaa

SEQ ID NO: 212506 - DNA, 25 bp, E. coli
gacctgcgcacagtggctctggaaa

SEQ ID NO: 212507 - DNA, 25 bp, E. coli
catttacaggctgataaccaggtca

SEQ ID NO: 212508 - DNA, 25 bp, E. coli
tatcagttagcgatgccagcgaact

SEQ ID NO: 212509 - DNA, 25 bp, E. coli
tatcagttagcgttgccagcgaact

SEQ ID NO: 212510 - DNA, 25 bp, E. coli
ttttgattggtagacaaatgctggc

SEQ ID NO: 212511 - DNA, 25 bp, E. coli
ttgcattactggacgtggacggcgc

SEQ ID NO: 212512 - DNA, 25 bp, E. coli
ttagcgatgccaccgaactgccgct

SEQ ID NO: 212513 - DNA, 25 bp, E. coli
ttgcattactggtcgtggacggcgc

SEQ ID NO: 212514 - DNA, 25 bp, E. coli
ttttgattggtacacaaatgctggc

SEQ ID NO: 212515 - DNA, 25 bp, E. coli
ttagcgatgccagcgaactgccgct

SEQ ID NO: 212516 - DNA, 25 bp, E. coli
tgccagcgaactgccgctcaatgag

SEQ ID NO: 212517 - DNA, 25 bp, E. coli
tgccagcgaactcccgctcaatgag

SEQ ID NO: 212518 - DNA, 25 bp, E. coli
tctgcgctgccagcactgtgacagt

SEQ ID NO: 212519 - DNA, 25 bp, E. coli
tctgcgctgccaccactgtgacagt

SEQ ID NO: 212520 - DNA, 25 bp, E. coli
gaactgccgctctatgagctaaaag

SEQ ID NO: 212521 - DNA, 25 bp, E. coli
gaactgccgctcaatgagctaaaag

SEQ ID NO: 212522 - DNA, 25 bp, E. coli
catttacaggctcataaccaggtca

SEQ ID NO: 212523 - DNA, 25 bp, E. coli
cggcgcgcggattttgattggtaca

SEQ ID NO: 212524 - DNA, 25 bp, E. coli
cggcgcgcggatattgattggtaca

SEQ ID NO: 212525 - DNA, 25 bp, E. coli
gattgtggtatctgttagcgatgcc

SEQ ID NO: 212526 - DNA, 25 bp, E. coli
gataaccaggtctttctctttctta

SEQ ID NO: 212527 - DNA, 25 bp, E. coli
gataaccaggtcattctctttctta

SEQ ID NO: 212528 - DNA, 25 bp, E. coli
gattgtggtatcagttagcgatgcc

SEQ ID NO: 212529 - DNA, 25 bp, E. coli
caagtgaaacaagggattcgccagt

SEQ ID NO: 212530 - DNA, 25 bp, E. coli
caattcgtcggcaggttgaaaacgc

SEQ ID NO: 212531 - DNA, 25 bp, E. coli
caagtgaaacaacggattcgccagt

SEQ ID NO: 212532 - DNA, 25 bp, E. coli
caaaagatctgtatgaagcgcggga

SEQ ID NO: 212533 - DNA, 25 bp, E. coli
caaaagatctgtttgaagcgcggga

SEQ ID NO: 212534 - DNA, 25 bp, E. coli
catgtttccgactggttagtgccga

SEQ ID NO: 212535 - DNA, 25 bp, E. coli
catgtttccgacaggttagtgccga

SEQ ID NO: 212536 - DNA, 25 bp, E. coli
cagtcagatcctccgtgccggaaaa

SEQ ID NO: 212537 - DNA, 25 bp, E. coli
cagtcagatcctgcgtgccggaaaa

SEQ ID NO: 212538 - DNA, 25 bp, E. coli
tactgccacattcgaaagaggtcgg

SEQ ID NO: 212539 - DNA, 25 bp, E. coli
tactgccacattggaaagaggtcgg

SEQ ID NO: 212540 - DNA, 25 bp, E. coli
caattcgtcggctggttgaaaacgc

SEQ ID NO: 212541 - DNA, 25 bp, E. coli
tatcaataccgccacactgggctat

SEQ ID NO: 212542 - DNA, 25 bp, E. coli
tatcaataccgcgacactgggctat

SEQ ID NO: 212543 - DNA, 25 bp, E. coli
tgtgatgaactccatcccgatggcg

SEQ ID NO: 212544 - DNA, 25 bp, E. coli
tgtgatgaactcgatcccgatggcg

SEQ ID NO: 212545 - DNA, 25 bp, E. coli
gcaaactggcgattgacgataaccg

SEQ ID NO: 212546 - DNA, 25 bp, E. coli
gcaaactggcgaatgacgataaccg

SEQ ID NO: 212547 - DNA, 25 bp, E. coli
gggtgaagatctgcagcaaatcgcc

SEQ ID NO: 212548 - DNA, 25 bp, E. coli
gggtgaagatctccagcaaatcgcc

SEQ ID NO: 212549 - DNA, 25 bp, E. coli
gagagatctgttacaacgcccggat

SEQ ID NO: 212550 - DNA, 25 bp, E. coli
gagagatctgtttcaacgcccggat

SEQ ID NO: 212551 - DNA, 25 bp, E. coli
ctttactttaagtcaattccaggca

SEQ ID NO: 212552 - DNA, 25 bp, E. coli
ctttactttaagacaattccaggca

SEQ ID NO: 212553 - DNA, 25 bp, E. coli
aacgtttatcatcttatcctaagga

SEQ ID NO: 212554 - DNA, 25 bp, E. coli
aacgtttatcatgttatcctaagga

SEQ ID NO: 212555 - DNA, 25 bp, E. coli
tatcgttacgcattgagtgagggta

SEQ ID NO: 212556 - DNA, 25 bp, E. coli
tatcgttacgcaatgagtgagggta

SEQ ID NO: 212557 - DNA, 25 bp, E. coli
tttacgggatagtaagtccgcctga

SEQ ID NO: 212558 - DNA, 25 bp, E. coli
tttacgggatagaaagtccgcctga

SEQ ID NO: 212559 - DNA, 25 bp, E. coli
tccgcctgaaaattcgcgagagtgg

SEQ ID NO: 212560 - DNA, 25 bp, E. coli
tccgcctgaaaaatcgcgagagtgg

SEQ ID NO: 212561 - DNA, 25 bp, E. coli
cgagagtggcgcattaggtgaccca

SEQ ID NO: 212562 - DNA, 25 bp, E. coli
cgagagtggcgctttaggtgaccca

SEQ ID NO: 212563 - DNA, 25 bp, E. coli
gttttaagctcagtcacatatcgca

SEQ ID NO: 212564 - DNA, 25 bp, E. coli
gttttaagctcactcacatatcgca

SEQ ID NO: 212565 - DNA, 25 bp, E. coli
ggtgacccatgttgttccgtttagt

SEQ ID NO: 212566 - DNA, 25 bp, E. coli
ggatactcctgctgcgaaatatttg

SEQ ID NO: 212567 - DNA, 25 bp, E. coli
ggatactcctgcagcgaaatatttg

SEQ ID NO: 212568 - DNA, 25 bp, E. coli
ggtgacccatgtagttccgtttagt

SEQ ID NO: 212569 - DNA, 25 bp, E. coli
ggcaaattatacaacactttacggg

SEQ ID NO: 212570 - DNA, 25 bp, E. coli
ggcaaattatactacactttacggg

SEQ ID NO: 212571 - DNA, 25 bp, E. coli
taatacctacgaacatcttccagga

SEQ ID NO: 212572 - DNA, 25 bp, E. coli
taatacctacgatcatcttccagga

SEQ ID NO: 212573 - DNA, 25 bp, E. coli
cacgacggcgcgtagctgtttgtcc

SEQ ID NO: 212574 - DNA, 25 bp, E. coli
cacgacggcgcgaagctgtttgtcc

SEQ ID NO: 212575 - DNA, 25 bp, E. coli
attgatggcacggaagtcgatttcg

SEQ ID NO: 212576 - DNA, 25 bp, E. coli
attgatggcacgcaagtcgatttcg

SEQ ID NO: 212577 - DNA, 25 bp, E. coli
tttcacaaccctaaagcccagaatg

SEQ ID NO: 212578 - DNA, 25 bp, E. coli
tttcacaacccttaagcccagaatg

SEQ ID NO: 212579 - DNA, 25 bp, E. coli
tgtttgtcccgcagcaagcgatgcc

SEQ ID NO: 212580 - DNA, 25 bp, E. coli
tgtttgtcccgctgcaagcgatgcc

SEQ ID NO: 212581 - DNA, 25 bp, E. coli
tcgacagtgttaccgagccggacaa

SEQ ID NO: 212582 - DNA, 25 bp, E. coli
tcgacagtgttagcgagccggacaa

SEQ ID NO: 212583 - DNA, 25 bp, E. coli
gcctggcaaggcataacgctgacac

SEQ ID NO: 212584 - DNA, 25 bp, E. coli
gcctggcaaggcttaacgctgacac

SEQ ID NO: 212585 - DNA, 25 bp, E. coli
gcgggctttggctatgtgctcgaca

SEQ ID NO: 212586 - DNA, 25 bp, E. coli
gcgggctttggcaatgtgctcgaca

SEQ ID NO: 212587 - DNA, 25 bp, E. coli
cccagaatgaatgtggctgtggcga

SEQ ID NO: 212588 - DNA, 25 bp, E. coli
cccagaatgaatctggctgtggcga

SEQ ID NO: 212589 - DNA, 25 bp, E. coli
gatctgctgtttgaacacgacggcg

SEQ ID NO: 212590 - DNA, 25 bp, E. coli
gatctgctgtttcaacacgacggcg

SEQ ID NO: 212591 - DNA, 25 bp, E. coli
tggacatgcattgaggaacctttaa

SEQ ID NO: 212592 - DNA, 25 bp, E. coli
tggacatgcattcaggaacctttaa

SEQ ID NO: 212593 - DNA, 25 bp, E. coli
gagccggacaaagacgatctgctgt

SEQ ID NO: 212594 - DNA, 25 bp, E. coli
gagccggacaaacacgatctgctgt

SEQ ID NO: 212595 - DNA, 25 bp, E. coli
aatcttcagtcaagaattcactacg

SEQ ID NO: 212596 - DNA, 25 bp, E. coli
aatcttcagtcatgaattcactacg

SEQ ID NO: 212597 - DNA, 25 bp, E. coli
cagccgctcatccattacgaggcag

SEQ ID NO: 212598 - DNA, 25 bp, E. coli
cagccgctcatcgattacgaggcag

SEQ ID NO: 212599 - DNA, 25 bp, E. coli
attacgaggcagcattcaaccgcgc

SEQ ID NO: 212600 - DNA, 25 bp, E. coli
attacgaggcaggattcaaccgcgc

SEQ ID NO: 212601 - DNA, 25 bp, E. coli
tttgtgccaccagtcagtctacgga

SEQ ID NO: 212602 - DNA, 25 bp, E. coli
tttgtgccaccactcagtctacgga

SEQ ID NO: 212603 - DNA, 25 bp, E. coli
ccactcagtctacggaaaaagaaga

SEQ ID NO: 212604 - DNA, 25 bp, E. coli
ccactcagtctagggaaaaagaaga

SEQ ID NO: 212605 - DNA, 25 bp, E. coli
gcggcagagacctgcaactggcgct

SEQ ID NO: 212606 - DNA, 25 bp, E. coli
gcggcagagaccagcaactggcgct

SEQ ID NO: 212607 - DNA, 25 bp, E. coli
gcagtattcgtttcgcccgttgtga

SEQ ID NO: 212608 - DNA, 25 bp, E. coli
gcagtattcgttacgcccgttgtga

SEQ ID NO: 212609 - DNA, 25 bp, E. coli
gtgctgacgttatcattaccagcct

SEQ ID NO: 212610 - DNA, 25 bp, E. coli
gtgctgacgttaacattaccagcct

SEQ ID NO: 212611 - DNA, 25 bp, E. coli
gtgcgccgggtgaaattccctctgc

SEQ ID NO: 212612 - DNA, 25 bp, E. coli
gtgcgccgggtgtaattccctctgc

SEQ ID NO: 212613 - DNA, 25 bp, E. coli
ggccaaagcgcaccaagcagaattt

SEQ ID NO: 212614 - DNA, 25 bp, E. coli
ggccaaagcgcagcaagcagaattt

SEQ ID NO: 212615 - DNA, 25 bp, E. coli
tcaaccgcgcatagcaggcggcaga

SEQ ID NO: 212616 - DNA, 25 bp, E. coli
tcaaccgcgcattgcaggcggcaga

SEQ ID NO: 212617 - DNA, 25 bp, E. coli
tatgagcactttccgaccacgcgta

SEQ ID NO: 212618 - DNA, 25 bp, E. coli
tatgagcactttgcgaccacgcgta

SEQ ID NO: 212619 - DNA, 25 bp, E. coli
tgtttattttcggtgcagcgggcgc

SEQ ID NO: 212620 - DNA, 25 bp, E. coli
tgtttattttcgctgcagcgggcgc

SEQ ID NO: 212621 - DNA, 25 bp, E. coli
tctgatgaaccgacgccgctatgag

SEQ ID NO: 212622 - DNA, 25 bp, E. coli
tcttttccgccactatgtggaccgg

SEQ ID NO: 212623 - DNA, 25 bp, E. coli
tcttttccgccagtatgtggaccgg

SEQ ID NO: 212624 - DNA, 25 bp, E. coli
tctgatgaaccgtcgccgctatgag

SEQ ID NO: 212625 - DNA, 25 bp, E. coli
gcaatgacgcatctggaggctaaca

SEQ ID NO: 212626 - DNA, 25 bp, E. coli
gcaatgacgcatgtggaggctaaca

SEQ ID NO: 212627 - DNA, 25 bp, E. coli
cgttagatttcaatgtcgcgctggc

SEQ ID NO: 212628 - DNA, 25 bp, E. coli
cgttagatttcattgtcgcgctggc

SEQ ID NO: 212629 - DNA, 25 bp, E. coli
ggtcgttcccgcacaaccgttagat

SEQ ID NO: 212630 - DNA, 25 bp, E. coli
ggtcgttcccgctcaaccgttagat

SEQ ID NO: 212631 - DNA, 25 bp, E. coli
ggcgcgctgagcaatctgatcctta

SEQ ID NO: 212632 - DNA, 25 bp, E. coli
ggcgcgctgagctatctgatcctta

SEQ ID NO: 212633 - DNA, 25 bp, E. coli
tggttgaccttcgtttcggcagcta

SEQ ID NO: 212634 - DNA, 25 bp, E. coli
tggttgaccttcctttcggcagcta

SEQ ID NO: 212635 - DNA, 25 bp, E. coli
gacgttcgtcatcctgggattaacc

SEQ ID NO: 212636 - DNA, 25 bp, E. coli
gatggtggcctttttcctcggcaac

SEQ ID NO: 212637 - DNA, 25 bp, E. coli
gacgttcgtcatgctgggattaacc

SEQ ID NO: 212638 - DNA, 25 bp, E. coli
gatggtggccttattcctcggcaac

SEQ ID NO: 212639 - DNA, 25 bp, E. coli
cactaaggttgcgtccgtgacttta

SEQ ID NO: 212640 - DNA, 25 bp, E. coli
cactaaggttgcctccgtgacttta

SEQ ID NO: 212641 - DNA, 25 bp, E. coli
catcggaacggaaaacaatggctac

SEQ ID NO: 212642 - DNA, 25 bp, E. coli
cagtccttgaaatgcatgttcgagg

SEQ ID NO: 212643 - DNA, 25 bp, E. coli
cagtccttgaaaagcatgttcgagg

SEQ ID NO: 212644 - DNA, 25 bp, E. coli
catcggaacggataacaatggctac

SEQ ID NO: 212645 - DNA, 25 bp, E. coli
tatgaatggcgatatcgcagtggca

SEQ ID NO: 212646 - DNA, 25 bp, E. coli
tatgaatggcgaaatcgcagtggca

SEQ ID NO: 212647 - DNA, 25 bp, E. coli
ttctcaatagcagccctgtcatcgg

SEQ ID NO: 212648 - DNA, 25 bp, E. coli
ttctcaatagcacccctgtcatcgg

SEQ ID NO: 212649 - DNA, 25 bp, E. coli
tgactttaagtatacagaaggcctt

SEQ ID NO: 212650 - DNA, 25 bp, E. coli
tgactttaagtaaacagaaggcctt

SEQ ID NO: 212651 - DNA, 25 bp, E. coli
gaaggccttcgaattctatcagtcc

SEQ ID NO: 212652 - DNA, 25 bp, E. coli
gaaggccttcgatttctatcagtcc

SEQ ID NO: 212653 - DNA, 25 bp, E. coli
ctgtcatcggccttatgaatggcga

SEQ ID NO: 212654 - DNA, 25 bp, E. coli
ctgtcatcggccatatgaatggcga

SEQ ID NO: 212655 - DNA, 25 bp, E. coli
gataacaatggctacgaagttttta

SEQ ID NO: 212656 - DNA, 25 bp, E. coli
gataacaatggcaacgaagttttta

SEQ ID NO: 212657 - DNA, 25 bp, E. coli
tggcaggaatgctgcgcactaaggt

SEQ ID NO: 212658 - DNA, 25 bp, E. coli
tggcaggaatgcagcgcactaaggt

SEQ ID NO: 212659 - DNA, 25 bp, E. coli
taacttcgtttttctcaatagcacc

SEQ ID NO: 212660 - DNA, 25 bp, E. coli
taacttcgttttactcaatagcacc

SEQ ID NO: 212661 - DNA, 25 bp, E. coli
cagcggccttcgctatctttttcgg

SEQ ID NO: 212662 - DNA, 25 bp, E. coli
cagcggccttcggtatctttttcgg

SEQ ID NO: 212663 - DNA, 25 bp, E. coli
catacgaaagtatagtcagccgggt

SEQ ID NO: 212664 - DNA, 25 bp, E. coli
catacgaaagtaaagtcagccgggt

SEQ ID NO: 212665 - DNA, 25 bp, E. coli
tgattttacgcagcaggtcagacgc

SEQ ID NO: 212666 - DNA, 25 bp, E. coli
tgattttacgcaccaggtcagacgc

SEQ ID NO: 212667 - DNA, 25 bp, E. coli
tcaacaacgaaggtcgcacggtcag

SEQ ID NO: 212668 - DNA, 25 bp, E. coli
gaattcgccgtttttgaatgcctgg

SEQ ID NO: 212669 - DNA, 25 bp, E. coli
gaattcgccgttattgaatgcctgg

SEQ ID NO: 212670 - DNA, 25 bp, E. coli
cgatggtttcagtgctgctgtgcca

SEQ ID NO: 212671 - DNA, 25 bp, E. coli
cgatggtttcagagctgctgtgcca

SEQ ID NO: 212672 - DNA, 25 bp, E. coli
cgcatgttgtcgtagttacgggtca

SEQ ID NO: 212673 - DNA, 25 bp, E. coli
cgcatgttgtcgaagttacgggtca

SEQ ID NO: 212674 - DNA, 25 bp, E. coli
cggccaatgcctacagcggtaactt

SEQ ID NO: 212675 - DNA, 25 bp, E. coli
cggccaatgccttcagcggtaactt

SEQ ID NO: 212676 - DNA, 25 bp, E. coli
gattgcctggatgataccctgcggg

SEQ ID NO: 212677 - DNA, 25 bp, E. coli
gattgcctggatcataccctgcggg

SEQ ID NO: 212678 - DNA, 25 bp, E. coli
ggtcagcaacgtgacccagttcggt

SEQ ID NO: 212679 - DNA, 25 bp, E. coli
ggtcagcaacgtcacccagttcggt

SEQ ID NO: 212680 - DNA, 25 bp, E. coli
tcagccgggtagtagaagaagacgc

SEQ ID NO: 212681 - DNA, 25 bp, E. coli
tcagccgggtagaagaagaagacgc

SEQ ID NO: 212682 - DNA, 25 bp, E. coli
tcaacaacgaagctcgcacggtcag

SEQ ID NO: 212683 - DNA, 25 bp, E. coli
aagtttggccttacatctcgtgcaa

SEQ ID NO: 212684 - DNA, 25 bp, E. coli
aagtttggcctttcatctcgtgcaa

SEQ ID NO: 212685 - DNA, 25 bp, E. coli
tatacgccgccttgcagtcacagta

SEQ ID NO: 212686 - DNA, 25 bp, E. coli
tatacgccgcctagcagtcacagta

SEQ ID NO: 212687 - DNA, 25 bp, E. coli
tatcgcaccacggtcattttaaatg

SEQ ID NO: 212688 - DNA, 25 bp, E. coli
tatcgcaccacgctcattttaaatg

SEQ ID NO: 212689 - DNA, 25 bp, E. coli
tttatgagtaattatcgcaccacgc

SEQ ID NO: 212690 - DNA, 25 bp, E. coli
tttatgagtaataatcgcaccacgc

SEQ ID NO: 212691 - DNA, 25 bp, E. coli
tcagaggattggtcaaagtttggcc

SEQ ID NO: 212692 - DNA, 25 bp, E. coli
tcagaggattggacaaagtttggcc

SEQ ID NO: 212693 - DNA, 25 bp, E. coli
gcaattctttgaaccatctcagagg

SEQ ID NO: 212694 - DNA, 25 bp, E. coli
gcaaaaaatgcgaaatatacgccgc

SEQ ID NO: 212695 - DNA, 25 bp, E. coli
gcagtcacagtatggtcatttctta

SEQ ID NO: 212696 - DNA, 25 bp, E. coli
gcaaaaaatgcgtaatatacgccgc

SEQ ID NO: 212697 - DNA, 25 bp, E. coli
gcaattctttgatccatctcagagg

SEQ ID NO: 212698 - DNA, 25 bp, E. coli
gcagtcacagtaaggtcatttctta

SEQ ID NO: 212699 - DNA, 25 bp, E. coli
cttcgcatcgccgtagggtgacgcg

SEQ ID NO: 212700 - DNA, 25 bp, E. coli
cttcgcatcgccctagggtgacgcg

SEQ ID NO: 212701 - DNA, 25 bp, E. coli
gggcgaagtgcgtgcaagctcacaa

SEQ ID NO: 212702 - DNA, 25 bp, E. coli
gggcgaagtgcgagcaagctcacaa

SEQ ID NO: 212703 - DNA, 25 bp, E. coli
gagcaagctcacaaaaggcacgtaa

SEQ ID NO: 212704 - DNA, 25 bp, E. coli
gagcaagctcactaaaggcacgtaa

SEQ ID NO: 212705 - DNA, 25 bp, E. coli
aatccgccctgtgtcaccagtttag

SEQ ID NO: 212706 - DNA, 25 bp, E. coli
aatccgccctgtctcaccagtttag

SEQ ID NO: 212707 - DNA, 25 bp, E. coli
cttggcttccggctatttgtgcgta

SEQ ID NO: 212708 - DNA, 25 bp, E. coli
cttggcttccgggtatttgtgcgta

SEQ ID NO: 212709 - DNA, 25 bp, E. coli
taaaacacctgataacgctacaagc

SEQ ID NO: 212710 - DNA, 25 bp, E. coli
taaaacacctgaaaacgctacaagc

SEQ ID NO: 212711 - DNA, 25 bp, E. coli
tagcgatctggatcaacgccttggc

SEQ ID NO: 212712 - DNA, 25 bp, E. coli
tatgaagtgcgtctggtgttagcac

SEQ ID NO: 212713 - DNA, 25 bp, E. coli
tagcgatctggaacaacgccttggc

SEQ ID NO: 212714 - DNA, 25 bp, E. coli
tatgaagtgcgtgtggtgttagcac

SEQ ID NO: 212715 - DNA, 25 bp, E. coli
tattgttgattcagatggttgccgc

SEQ ID NO: 212716 - DNA, 25 bp, E. coli
tattcgccgatgttcgactatgaag

SEQ ID NO: 212717 - DNA, 25 bp, E. coli
tattcgccgatgatcgactatgaag

SEQ ID NO: 212718 - DNA, 25 bp, E. coli
tattgttgattctgatggttgccgc

SEQ ID NO: 212719 - DNA, 25 bp, E. coli
gccatagctgtaatcagtggctgac

SEQ ID NO: 212720 - DNA, 25 bp, E. coli
gccatagctgtattcagtggctgac

SEQ ID NO: 212721 - DNA, 25 bp, E. coli
gctacaagcgttgcggaactgcggc

SEQ ID NO: 212722 - DNA, 25 bp, E. coli
gctacaagcgttccggaactgcggc

SEQ ID NO: 212723 - DNA, 25 bp, E. coli
cgaaggcttgtggagccgactgtac

SEQ ID NO: 212724 - DNA, 25 bp, E. coli
cgaaggcttgtgcagccgactgtac

SEQ ID NO: 212725 - DNA, 25 bp, E. coli
gtgttagcacctcaccatccactgg

SEQ ID NO: 212726 - DNA, 25 bp, E. coli
gtgttagcacctgaccatccactgg

SEQ ID NO: 212727 - DNA, 25 bp, E. coli
aataccgcagcacgaatgtttatgg

SEQ ID NO: 212728 - DNA, 25 bp, E. coli
aataccgcagcaggaatgtttatgg

SEQ ID NO: 212729 - DNA, 25 bp, E. coli
cagcaggaatgtttatgggaaccgc

SEQ ID NO: 212730 - DNA, 25 bp, E. coli
caggaatgtttatgggaaccgccgc

SEQ ID NO: 212731 - DNA, 25 bp, E. coli
cagcaggaatgtatatgggaaccgc

SEQ ID NO: 212732 - DNA, 25 bp, E. coli
caggaatgtttaagggaaccgccgc

SEQ ID NO: 212733 - DNA, 25 bp, E. coli
atgtttatgggatccgccgcgctgg

SEQ ID NO: 212734 - DNA, 25 bp, E. coli
atgtttatgggaaccgccgcgctgg

SEQ ID NO: 212735 - DNA, 25 bp, E. coli
taccgcagcaggtatgtttatggga

SEQ ID NO: 212736 - DNA, 25 bp, E. coli
taccgcagcaggaatgtttatggga

SEQ ID NO: 212737 - DNA, 25 bp, E. coli
gaatgtttatggcaaccgccgcgct

SEQ ID NO: 212738 - DNA, 25 bp, E. coli
gaatgtttatgggaaccgccgcgct

SEQ ID NO: 212739 - DNA, 25 bp, E. coli
cgctggctggcggtatttttaacgc

SEQ ID NO: 212740 - DNA, 25 bp, E. coli
cgcagcaggaatctttatgggaacc

SEQ ID NO: 212741 - DNA, 25 bp, E. coli
cgctggctggcgctatttttaacgc

SEQ ID NO: 212742 - DNA, 25 bp, E. coli
cgcagcaggaatgtttatgggaacc

SEQ ID NO: 212743 - DNA, 25 bp, E. coli
ctggcggtatttataacgcagcttg

SEQ ID NO: 212744 - DNA, 25 bp, E. coli
ctggcggtatttttaacgcagcttg

SEQ ID NO: 212745 - DNA, 25 bp, E. coli
tggctggcggtatttttaacgcagc

SEQ ID NO: 212746 - DNA, 25 bp, E. coli
tggctggcggtaattttaacgcagc

SEQ ID NO: 212747 - DNA, 25 bp, E. coli
tcacaataccgcagcaggaatgttt

SEQ ID NO: 212748 - DNA, 25 bp, E. coli
tcacaataccgctgcaggaatgttt

SEQ ID NO: 212749 - DNA, 25 bp, E. coli
cacgtccgttgacaaattggcaata

SEQ ID NO: 212750 - DNA, 25 bp, E. coli
aactgggcagactttgccggatgcg

SEQ ID NO: 212751 - DNA, 25 bp, E. coli
cacgtccgttgagaaattggcaata

SEQ ID NO: 212752 - DNA, 25 bp, E. coli
caaattggcaatatgataacatccg

SEQ ID NO: 212753 - DNA, 25 bp, E. coli
caaattggcaatttgataacatccg

SEQ ID NO: 212754 - DNA, 25 bp, E. coli
aactgggcagacattgccggatgcg

SEQ ID NO: 212755 - DNA, 25 bp, E. coli
tgtgtgacggaagaataaacgtaga

SEQ ID NO: 212756 - DNA, 25 bp, E. coli
tgtgtgacggaacaataaacgtaga

SEQ ID NO: 212757 - DNA, 25 bp, E. coli
tccggcctggagtaacgtgctgaac

SEQ ID NO: 212758 - DNA, 25 bp, E. coli
tccggcctggagaaacgtgctgaac

SEQ ID NO: 212759 - DNA, 25 bp, E. coli
tcatcacgtccgttgacaaattggc

SEQ ID NO: 212760 - DNA, 25 bp, E. coli
tcttatccggcctggagtaacgtgc

SEQ ID NO: 212761 - DNA, 25 bp, E. coli
tcatcacgtccgatgacaaattggc

SEQ ID NO: 212762 - DNA, 25 bp, E. coli
tcttatccggccaggagtaacgtgc

SEQ ID NO: 212763 - DNA, 25 bp, E. coli
gccagattggcatcggatgaattta

SEQ ID NO: 212764 - DNA, 25 bp, E. coli
gccagattggcaacggatgaattta

SEQ ID NO: 212765 - DNA, 25 bp, E. coli
gataacatccgttgccagattggca

SEQ ID NO: 212766 - DNA, 25 bp, E. coli
gataacatccgtagccagattggca

SEQ ID NO: 212767 - DNA, 25 bp, E. coli
gtaacgtgctgaacgtaggccggat

SEQ ID NO: 212768 - DNA, 25 bp, E. coli
gtaacgtgctgatcgtaggccggat

SEQ ID NO: 212769 - DNA, 25 bp, E. coli
gatgaatttatctgtgtgacggaag

SEQ ID NO: 212770 - DNA, 25 bp, E. coli
gatgaatttatcagtgtgacggaag

SEQ ID NO: 212771 - DNA, 25 bp, E. coli
caagcacaatgaacatcgtggcgat

SEQ ID NO: 212772 - DNA, 25 bp, E. coli
caagcacaatgatcatcgtggcgat

SEQ ID NO: 212773 - DNA, 25 bp, E. coli
cacaatgatcatcgtggcgatcatc

SEQ ID NO: 212774 - DNA, 25 bp, E. coli
cacaatgatcatggtggcgatcatc

SEQ ID NO: 212775 - DNA, 25 bp, E. coli
taacaagcacaatgatcatcgtggc

SEQ ID NO: 212776 - DNA, 25 bp, E. coli
taacaagcacaaagatcatcgtggc

SEQ ID NO: 212777 - DNA, 25 bp, E. coli
atcatcgtggcgttcatcgtccggg

SEQ ID NO: 212778 - DNA, 25 bp, E. coli
atcgccgcgccataacaagcacaat

SEQ ID NO: 212779 - DNA, 25 bp, E. coli
atcatcgtggcgatcatcgtccggg

SEQ ID NO: 212780 - DNA, 25 bp, E. coli
atcgccgcgccaaaacaagcacaat

SEQ ID NO: 212781 - DNA, 25 bp, E. coli
tcgtccggggccagacaaacatcat

SEQ ID NO: 212782 - DNA, 25 bp, E. coli
gccgcgccataacaagcacaatgat

SEQ ID NO: 212783 - DNA, 25 bp, E. coli
gccgcgccataagaagcacaatgat

SEQ ID NO: 212784 - DNA, 25 bp, E. coli
tcgtccggggcctgacaaacatcat

SEQ ID NO: 212785 - DNA, 25 bp, E. coli
gcgccataacaagcacaatgatcat

SEQ ID NO: 212786 - DNA, 25 bp, E. coli
gcacccatatggaccgccgccatcg

SEQ ID NO: 212787 - DNA, 25 bp, E. coli
gcgccataacaaccacaatgatcat

SEQ ID NO: 212788 - DNA, 25 bp, E. coli
gcacccatatggtccgccgccatcg

SEQ ID NO: 212789 - DNA, 25 bp, E. coli
gatcatcgtggcgatcatcgtccgg

SEQ ID NO: 212790 - DNA, 25 bp, E. coli
gatcatcgtggccatcatcgtccgg

SEQ ID NO: 212791 - DNA, 25 bp, E. coli
ggggcctgacaatcatcatcgctaa

SEQ ID NO: 212792 - DNA, 25 bp, E. coli
ggggcctgacaaacatcatcgctaa

SEQ ID NO: 212793 - DNA, 25 bp, E. coli
caagatttttatgctgtcgtcggag

SEQ ID NO: 212794 - DNA, 25 bp, E. coli
caagatttttatcctgtcgtcggag

SEQ ID NO: 212795 - DNA, 25 bp, E. coli
ttcgcgatctgaacaacgattcgtg

SEQ ID NO: 212796 - DNA, 25 bp, E. coli
ttcgcgatctgatcaacgattcgtg

SEQ ID NO: 212797 - DNA, 25 bp, E. coli
tgagttaccctttgtcgagctttgc

SEQ ID NO: 212798 - DNA, 25 bp, E. coli
tgagttacccttagtcgagctttgc

SEQ ID NO: 212799 - DNA, 25 bp, E. coli
tcgagctttgctcgccttttggccc

SEQ ID NO: 212800 - DNA, 25 bp, E. coli
tcgagctttgctggccttttggccc

SEQ ID NO: 212801 - DNA, 25 bp, E. coli
tctgaagtccgaaccacaaaaatcc

SEQ ID NO: 212802 - DNA, 25 bp, E. coli
tctgaagtccgatccacaaaaatcc

SEQ ID NO: 212803 - DNA, 25 bp, E. coli
gcggcgtcccctttatcaatctgaa

SEQ ID NO: 212804 - DNA, 25 bp, E. coli
gcggcgtcccctatatcaatctgaa

SEQ ID NO: 212805 - DNA, 25 bp, E. coli
gaaatctccgaaccgttacttcgcg

SEQ ID NO: 212806 - DNA, 25 bp, E. coli
gaaatctccgaagcgttacttcgcg

SEQ ID NO: 212807 - DNA, 25 bp, E. coli
ggtatcacatgaataaaaagcactg

SEQ ID NO: 212808 - DNA, 25 bp, E. coli
ggtatcacatgattaaaaagcactg

SEQ ID NO: 212809 - DNA, 25 bp, E. coli
taagcaatcactccacgaaacggcg

SEQ ID NO: 212810 - DNA, 25 bp, E. coli
taagcaatcactgcacgaaacggcg

SEQ ID NO: 212811 - DNA, 25 bp, E. coli
gatggtctggctaaacgcgatcaaa

SEQ ID NO: 212812 - DNA, 25 bp, E. coli
gatggtctggcttaacgcgatcaaa

SEQ ID NO: 212813 - DNA, 25 bp, E. coli
gatgtttttaaaattggcggcaaga

SEQ ID NO: 212814 - DNA, 25 bp, E. coli
gatgtttttaaatttggcggcaaga

SEQ ID NO: 212815 - DNA, 25 bp, E. coli
caaggacatccttatagcaaaaggg

SEQ ID NO: 212816 - DNA, 25 bp, E. coli
caaggacatcctaatagcaaaaggg

SEQ ID NO: 212817 - DNA, 25 bp, E. coli
caggaatacgatatataatgacggg

SEQ ID NO: 212818 - DNA, 25 bp, E. coli
caggaatacgatttataatgacggg

SEQ ID NO: 212819 - DNA, 25 bp, E. coli
aaaattgccgctaaaagagaagtgt

SEQ ID NO: 212820 - DNA, 25 bp, E. coli
aaatgaataatggaaaaattgccgc

SEQ ID NO: 212821 - DNA, 25 bp, E. coli
aaatgaataatgcaaaaattgccgc

SEQ ID NO: 212822 - DNA, 25 bp, E. coli
aaaaaatactgaggcgccgggcatc

SEQ ID NO: 212823 - DNA, 25 bp, E. coli
aaaaaatactgacgcgccgggcatc

SEQ ID NO: 212824 - DNA, 25 bp, E. coli
aaaattgccgcttaaagagaagtgt

SEQ ID NO: 212825 - DNA, 25 bp, E. coli
taggaaaacctgaaggcacgattgt

SEQ ID NO: 212826 - DNA, 25 bp, E. coli
taggaaaacctgtaggcacgattgt

SEQ ID NO: 212827 - DNA, 25 bp, E. coli
gcgccgggcatcgtcaaataggaaa

SEQ ID NO: 212828 - DNA, 25 bp, E. coli
gcgccgggcatcctcaaataggaaa

SEQ ID NO: 212829 - DNA, 25 bp, E. coli
gcaacggctaattatcatccaggaa

SEQ ID NO: 212830 - DNA, 25 bp, E. coli
gcaacggctaataatcatccaggaa

SEQ ID NO: 212831 - DNA, 25 bp, E. coli
ggcacgattgtttaatctcccacgg

SEQ ID NO: 212832 - DNA, 25 bp, E. coli
ggcacgattgttaaatctcccacgg

SEQ ID NO: 212833 - DNA, 25 bp, E. coli
taatgacgggatttagcgctaagta

SEQ ID NO: 212834 - DNA, 25 bp, E. coli
taatgacgggatatagcgctaagta

SEQ ID NO: 212835 - DNA, 25 bp, E. coli
gagaagtgtttatcagcaacggcta

SEQ ID NO: 212836 - DNA, 25 bp, E. coli
gagaagtgtttaacagcaacggcta

SEQ ID NO: 212837 - DNA, 25 bp, E. coli
cacagactcgatcactgcgcagtca

SEQ ID NO: 212838 - DNA, 25 bp, E. coli
cacagactcgatgactgcgcagtca

SEQ ID NO: 212839 - DNA, 25 bp, E. coli
catatagactaattagctgcgccta

SEQ ID NO: 212840 - DNA, 25 bp, E. coli
cagtcatacagtcaaattgccctaa

SEQ ID NO: 212841 - DNA, 25 bp, E. coli
cagtcatacagtgaaattgccctaa

SEQ ID NO: 212842 - DNA, 25 bp, E. coli
catatagactaaatagctgcgccta

SEQ ID NO: 212843 - DNA, 25 bp, E. coli
acaagtgatacgatgcaaaaggagc

SEQ ID NO: 212844 - DNA, 25 bp, E. coli
aaagtagagcacaattccgcgtagc

SEQ ID NO: 212845 - DNA, 25 bp, E. coli
acaagtgatacgttgcaaaaggagc

SEQ ID NO: 212846 - DNA, 25 bp, E. coli
aaagtagagcactattccgcgtagc

SEQ ID NO: 212847 - DNA, 25 bp, E. coli
ttttagaaatatcagcccagagagc

SEQ ID NO: 212848 - DNA, 25 bp, E. coli
ttgcaaaaggaggaacaccccacag

SEQ ID NO: 212849 - DNA, 25 bp, E. coli
ttttagaaatatgagcccagagagc

SEQ ID NO: 212850 - DNA, 25 bp, E. coli
ttgcaaaaggagcaacaccccacag

SEQ ID NO: 212851 - DNA, 25 bp, E. coli
tgaaagggctaaacgaaagtagagc

SEQ ID NO: 212852 - DNA, 25 bp, E. coli
tgaaagggctaatcgaaagtagagc

SEQ ID NO: 212853 - DNA, 25 bp, E. coli
tccgcgtagctaattagtgcgatct

SEQ ID NO: 212854 - DNA, 25 bp, E. coli
tccgcgtagctatttagtgcgatct

SEQ ID NO: 212855 - DNA, 25 bp, E. coli
cctaatgtcttacctctgaaagggc

SEQ ID NO: 212856 - DNA, 25 bp, E. coli
cctaatgtcttagctctgaaagggc

SEQ ID NO: 212857 - DNA, 25 bp, E. coli
gctgcgcctaatacatctacacttt

SEQ ID NO: 212858 - DNA, 25 bp, E. coli
gctgcgcctaattcatctacacttt

SEQ ID NO: 212859 - DNA, 25 bp, E. coli
caatcggaatttacgggagcatagt

SEQ ID NO: 212860 - DNA, 25 bp, E. coli
caatcggaattttcgggagcatagt

SEQ ID NO: 212861 - DNA, 25 bp, E. coli
caaaaggcgggccaggacaatccat

SEQ ID NO: 212862 - DNA, 25 bp, E. coli
caaaaggcgggcgaggacaatccat

SEQ ID NO: 212863 - DNA, 25 bp, E. coli
tacgggagcatagtaatgacagata

SEQ ID NO: 212864 - DNA, 25 bp, E. coli
tacgggagcatactaatgacagata

SEQ ID NO: 212865 - DNA, 25 bp, E. coli
tatccaatcggattttacgggagca

SEQ ID NO: 212866 - DNA, 25 bp, E. coli
tatccaatcggaatttacgggagca

SEQ ID NO: 212867 - DNA, 25 bp, E. coli
tgattgcccgcaaaaggcgggccag

SEQ ID NO: 212868 - DNA, 25 bp, E. coli
tgattgcccgcataaggcgggccag

SEQ ID NO: 212869 - DNA, 25 bp, E. coli
tccatagccgatatccaatcggaat

SEQ ID NO: 212870 - DNA, 25 bp, E. coli
tccatagccgatttccaatcggaat

SEQ ID NO: 212871 - DNA, 25 bp, E. coli
gaatttacgggagcatagtaatgac

SEQ ID NO: 212872 - DNA, 25 bp, E. coli
gaatttacgggaccatagtaatgac

SEQ ID NO: 212873 - DNA, 25 bp, E. coli
gatatccaatcgcaatttacgggag

SEQ ID NO: 212874 - DNA, 25 bp, E. coli
gatatccaatcggaatttacgggag

SEQ ID NO: 212875 - DNA, 25 bp, E. coli
gggccaggacaaaccatagccgata

SEQ ID NO: 212876 - DNA, 25 bp, E. coli
gggccaggacaatccatagccgata

SEQ ID NO: 212877 - DNA, 25 bp, E. coli
ggacaatccatagccgatatccaat

SEQ ID NO: 212878 - DNA, 25 bp, E. coli
ggacaatccatacccgatatccaat

SEQ ID NO: 212879 - DNA, 25 bp, E. coli
gagcatagtaatcacagatattgcg

SEQ ID NO: 212880 - DNA, 25 bp, E. coli
gagcatagtaatgacagatattgcg

SEQ ID NO: 212881 - DNA, 25 bp, E. coli
caacgggcggttattcctctgaaag

SEQ ID NO: 212882 - DNA, 25 bp, E. coli
caacgggcggtttttcctctgaaag

SEQ ID NO: 212883 - DNA, 25 bp, E. coli
taacgttctgatagcagcaccaggc

SEQ ID NO: 212884 - DNA, 25 bp, E. coli
tagtagtggccaaaccgcagaatgg

SEQ ID NO: 212885 - DNA, 25 bp, E. coli
tagtagtggccataccgcagaatgg

SEQ ID NO: 212886 - DNA, 25 bp, E. coli
ttttggcgcgattgcgacgctggac

SEQ ID NO: 212887 - DNA, 25 bp, E. coli
ttttggcgcgatagcgacgctggac

SEQ ID NO: 212888 - DNA, 25 bp, E. coli
tgagctacagcgagcaacagggata

SEQ ID NO: 212889 - DNA, 25 bp, E. coli
tgaaaactgactggcgcggatatac

SEQ ID NO: 212890 - DNA, 25 bp, E. coli
tgagctacagcgtgcaacagggata

SEQ ID NO: 212891 - DNA, 25 bp, E. coli
tgaaaactgactcgcgcggatatac

SEQ ID NO: 212892 - DNA, 25 bp, E. coli
tctgaaaggcgatctgaccgtaggt

SEQ ID NO: 212893 - DNA, 25 bp, E. coli
tctcagcagctatttgcaacgggcg

SEQ ID NO: 212894 - DNA, 25 bp, E. coli
tctcagcagctaattgcaacgggcg

SEQ ID NO: 212895 - DNA, 25 bp, E. coli
tctgaaaggcgaactgaccgtaggt

SEQ ID NO: 212896 - DNA, 25 bp, E. coli
gaatactcgtgtggcgaacagcacc

SEQ ID NO: 212897 - DNA, 25 bp, E. coli
gaatactcgtgtcgcgaacagcacc

SEQ ID NO: 212898 - DNA, 25 bp, E. coli
ggtatcgccaaatgcaatgcccaga

SEQ ID NO: 212899 - DNA, 25 bp, E. coli
ggtatcgccaaaagcaatgcccaga

SEQ ID NO: 212900 - DNA, 25 bp, E. coli
taacgttctgattgcagcaccaggc

SEQ ID NO: 212901 - DNA, 25 bp, E. coli
gagagcaaatttccccaggccacgt

SEQ ID NO: 212902 - DNA, 25 bp, E. coli
gagagcaaatttgcccaggccacgt

SEQ ID NO: 212903 - DNA, 25 bp, E. coli
aaggtctgcaaacagggattgctgc

SEQ ID NO: 212904 - DNA, 25 bp, E. coli
aagcgctgatttgttaatgtgatcg

SEQ ID NO: 212905 - DNA, 25 bp, E. coli
aaggtctgcaaagagggattgctgc

SEQ ID NO: 212906 - DNA, 25 bp, E. coli
aagcgctgatttcttaatgtgatcg

SEQ ID NO: 212907 - DNA, 25 bp, E. coli
caaagagggattcctgcaaactgca

SEQ ID NO: 212908 - DNA, 25 bp, E. coli
caaagagggattgctgcaaactgca

SEQ ID NO: 212909 - DNA, 25 bp, E. coli
tacgaattaattctatgatgaatcc

SEQ ID NO: 212910 - DNA, 25 bp, E. coli
tacgaattaattgtatgatgaatcc

SEQ ID NO: 212911 - DNA, 25 bp, E. coli
tatgttagcgccaatggtcagcgga

SEQ ID NO: 212912 - DNA, 25 bp, E. coli
tatgttagcgcctatggtcagcgga

SEQ ID NO: 212913 - DNA, 25 bp, E. coli
tgtgatcggtaggacgttttacgaa

SEQ ID NO: 212914 - DNA, 25 bp, E. coli
tgtgatcggtagcacgttttacgaa

SEQ ID NO: 212915 - DNA, 25 bp, E. coli
tcgctgcgcattgcgtaatgccggg

SEQ ID NO: 212916 - DNA, 25 bp, E. coli
tcgctgcgcattccgtaatgccggg

SEQ ID NO: 212917 - DNA, 25 bp, E. coli
gcaatccctctcaatgcttgatgta

SEQ ID NO: 212918 - DNA, 25 bp, E. coli
gcaatccctctctatgcttgatgta

SEQ ID NO: 212919 - DNA, 25 bp, E. coli
ctatggtcagcggattaaaggtctg

SEQ ID NO: 212920 - DNA, 25 bp, E. coli
ctatggtcagcgcattaaaggtctg

SEQ ID NO: 212921 - DNA, 25 bp, E. coli
gggagcgaaaaattaagcgctgatt

SEQ ID NO: 212922 - DNA, 25 bp, E. coli
gggagcgaaaaaataagcgctgatt

SEQ ID NO: 212923 - DNA, 25 bp, E. coli
gatgtatgcctgagttcgctgcgca

SEQ ID NO: 212924 - DNA, 25 bp, E. coli
gatgtatgcctgtgttcgctgcgca

SEQ ID NO: 212925 - DNA, 25 bp, E. coli
cagttactgctctcccgtttgatga

SEQ ID NO: 212926 - DNA, 25 bp, E. coli
cagttactgctcacccgtttgatga

SEQ ID NO: 212927 - DNA, 25 bp, E. coli
tacgcattgatgagatcgcagagtt

SEQ ID NO: 212928 - DNA, 25 bp, E. coli
tacgcattgatgtgatcgcagagtt

SEQ ID NO: 212929 - DNA, 25 bp, E. coli
tgaaccacgatatcccgctaaaata

SEQ ID NO: 212930 - DNA, 25 bp, E. coli
tgaaccacgataacccgctaaaata

SEQ ID NO: 212931 - DNA, 25 bp, E. coli
tcccgtacgcattgatgagatcgca

SEQ ID NO: 212932 - DNA, 25 bp, E. coli
tcccgtacgcatagatgagatcgca

SEQ ID NO: 212933 - DNA, 25 bp, E. coli
gctggcccactagttccagttactg

SEQ ID NO: 212934 - DNA, 25 bp, E. coli
gctggcccactacttccagttactg

SEQ ID NO: 212935 - DNA, 25 bp, E. coli
ccgaatgcgcagagcctgtcgcaga

SEQ ID NO: 212936 - DNA, 25 bp, E. coli
ccgctaaaatattttgatattgccg

SEQ ID NO: 212937 - DNA, 25 bp, E. coli
ccgctaaaatatattgatattgccg

SEQ ID NO: 212938 - DNA, 25 bp, E. coli
ccgaatgcgcagtgcctgtcgcaga

SEQ ID NO: 212939 - DNA, 25 bp, E. coli
gatattgccgatgagtacgcgaccg

SEQ ID NO: 212940 - DNA, 25 bp, E. coli
gatattgccgatcagtacgcgaccg

SEQ ID NO: 212941 - DNA, 25 bp, E. coli
gggattaatcccctacgcattgatg

SEQ ID NO: 212942 - DNA, 25 bp, E. coli
gggattaatcccgtacgcattgatg

SEQ ID NO: 212943 - DNA, 25 bp, E. coli
gatcgcagagttattgaatcaatgg

SEQ ID NO: 212944 - DNA, 25 bp, E. coli
gatgagtacgcgaccgaatgcgcag

SEQ ID NO: 212945 - DNA, 25 bp, E. coli
gatcgcagagtttttgaatcaatgg

SEQ ID NO: 212946 - DNA, 25 bp, E. coli
gatgagtacgcgtccgaatgcgcag

SEQ ID NO: 212947 - DNA, 25 bp, E. coli
cacaaacacatactacgtgatcgct

SEQ ID NO: 212948 - DNA, 25 bp, E. coli
caaaacaactcagtccttaccagga

SEQ ID NO: 212949 - DNA, 25 bp, E. coli
cacaaacacatagtacgtgatcgct

SEQ ID NO: 212950 - DNA, 25 bp, E. coli
caaaacaactcactccttaccagga

SEQ ID NO: 212951 - DNA, 25 bp, E. coli
catactacgtgatcgcttcctgtcc

SEQ ID NO: 212952 - DNA, 25 bp, E. coli
catactacgtgaacgcttcctgtcc

SEQ ID NO: 212953 - DNA, 25 bp, E. coli
aaaaagtgaagcagatgcagaagga

SEQ ID NO: 212954 - DNA, 25 bp, E. coli
aaaaagtgaagctgatgcagaagga

SEQ ID NO: 212955 - DNA, 25 bp, E. coli
ttcaagcagcctcgtcgattccggg

SEQ ID NO: 212956 - DNA, 25 bp, E. coli
ttcaagcagcctggtcgattccggg

SEQ ID NO: 212957 - DNA, 25 bp, E. coli
tgatcgcttcctctccagcttcaag

SEQ ID NO: 212958 - DNA, 25 bp, E. coli
tgtccagcttcatgcagcctggtcg

SEQ ID NO: 212959 - DNA, 25 bp, E. coli
tgatcgcttcctgtccagcttcaag

SEQ ID NO: 212960 - DNA, 25 bp, E. coli
tgtccagcttcaagcagcctggtcg

SEQ ID NO: 212961 - DNA, 25 bp, E. coli
tccttaccaggacaaaattcacaaa

SEQ ID NO: 212962 - DNA, 25 bp, E. coli
tccttaccaggagaaaattcacaaa

SEQ ID NO: 212963 - DNA, 25 bp, E. coli
gctgatgcagaaggagaaaggtcat

SEQ ID NO: 212964 - DNA, 25 bp, E. coli
gctgatgcagaacgagaaaggtcat

SEQ ID NO: 212965 - DNA, 25 bp, E. coli
gcagaaggagaatggtcatgagtaa

SEQ ID NO: 212966 - DNA, 25 bp, E. coli
gcagaaggagaaaggtcatgagtaa

SEQ ID NO: 212967 - DNA, 25 bp, E. coli
ggacaaaattcacaaacacatacta

SEQ ID NO: 212968 - DNA, 25 bp, E. coli
ggacaaaattcagaaacacatacta

SEQ ID NO: 212969 - DNA, 25 bp, E. coli
cagcgcaggtgtattgtgttcaccg

SEQ ID NO: 212970 - DNA, 25 bp, E. coli
cagcgcaggtgttttgtgttcaccg

SEQ ID NO: 212971 - DNA, 25 bp, E. coli
tacctttacaacattgcgttaacag

SEQ ID NO: 212972 - DNA, 25 bp, E. coli
aatactgtcgtaggcttatctttcg

SEQ ID NO: 212973 - DNA, 25 bp, E. coli
aatactgtcgtacgcttatctttcg

SEQ ID NO: 212974 - DNA, 25 bp, E. coli
tacctttacaactttgcgttaacag

SEQ ID NO: 212975 - DNA, 25 bp, E. coli
tatctttcgacaatgaggccgtcgg

SEQ ID NO: 212976 - DNA, 25 bp, E. coli
tatctttcgacattgaggccgtcgg

SEQ ID NO: 212977 - DNA, 25 bp, E. coli
tgtgttcaccgctcaccaaagacat

SEQ ID NO: 212978 - DNA, 25 bp, E. coli
tgtgttcaccgcacaccaaagacat

SEQ ID NO: 212979 - DNA, 25 bp, E. coli
tgcgttaacagtgaatgacacttct

SEQ ID NO: 212980 - DNA, 25 bp, E. coli
tgcgttaacagtcaatgacacttct

SEQ ID NO: 212981 - DNA, 25 bp, E. coli
taaatgatagtaccgtctaagtgac

SEQ ID NO: 212982 - DNA, 25 bp, E. coli
taaatgatagtagcgtctaagtgac

SEQ ID NO: 212983 - DNA, 25 bp, E. coli
tctaagtgacctaagctctgctgca

SEQ ID NO: 212984 - DNA, 25 bp, E. coli
tctaagtgaccttagctctgctgca

SEQ ID NO: 212985 - DNA, 25 bp, E. coli
gactaatgtaatcgttgctgatgaa

SEQ ID NO: 212986 - DNA, 25 bp, E. coli
gactaatgtaatggttgctgatgaa

SEQ ID NO: 212987 - DNA, 25 bp, E. coli
taataccggacatctaagttgaaga

SEQ ID NO: 212988 - DNA, 25 bp, E. coli
taataccggacaactaagttgaaga

SEQ ID NO: 212989 - DNA, 25 bp, E. coli
gaggccgtcggctaaataaaatgac

SEQ ID NO: 212990 - DNA, 25 bp, E. coli
gaggccgtcggcaaaataaaatgac

SEQ ID NO: 212991 - DNA, 25 bp, E. coli
catgggttcgcctgcaagttccggc

SEQ ID NO: 212992 - DNA, 25 bp, E. coli
aatattgcgaatgcgctggcagccg

SEQ ID NO: 212993 - DNA, 25 bp, E. coli
aatattgcgaatccgctggcagccg

SEQ ID NO: 212994 - DNA, 25 bp, E. coli
catgggttcgccagcaagttccggc

SEQ ID NO: 212995 - DNA, 25 bp, E. coli
caaatctgaaagctgttccaggccg

SEQ ID NO: 212996 - DNA, 25 bp, E. coli
caaatctgaaaggtgttccaggccg

SEQ ID NO: 212997 - DNA, 25 bp, E. coli
cagttattgaacatggcgcgaacca

SEQ ID NO: 212998 - DNA, 25 bp, E. coli
cagttattgaacttggcgcgaacca

SEQ ID NO: 212999 - DNA, 25 bp, E. coli
tacgcgctttacaggagaatgggac

SEQ ID NO: 213000 - DNA, 25 bp, E. coli
tacgcgctttactggagaatgggac

SEQ ID NO: 213001 - DNA, 25 bp, E. coli
tgtttgttgcccagaaaggcgaacg

SEQ ID NO: 213002 - DNA, 25 bp, E. coli
tgtttgttgccctgaaaggcgaacg

SEQ ID NO: 213003 - DNA, 25 bp, E. coli
tccgtgggcgcatcgcttgatgcta

SEQ ID NO: 213004 - DNA, 25 bp, E. coli
tccgtgggcgcaacgcttgatgcta

SEQ ID NO: 213005 - DNA, 25 bp, E. coli
tctcaacggtgaactgcaaggtgca

SEQ ID NO: 213006 - DNA, 25 bp, E. coli
tctcaacggtgatctgcaaggtgca

SEQ ID NO: 213007 - DNA, 25 bp, E. coli
gcaaaagctgctggtattgaccgcg

SEQ ID NO: 213008 - DNA, 25 bp, E. coli
gcaaaagctgctcgtattgaccgcg

SEQ ID NO: 213009 - DNA, 25 bp, E. coli
taatcgtcaaggatacgcgtctggc

SEQ ID NO: 213010 - DNA, 25 bp, E. coli
taatcgtcaaggttacgcgtctggc

SEQ ID NO: 213011 - DNA, 25 bp, E. coli
gacgctgttgcgcttaacgccggaa

SEQ ID NO: 213012 - DNA, 25 bp, E. coli
gacgctgttgcggttaacgccggaa

SEQ ID NO: 213013 - DNA, 25 bp, E. coli
tacgagaaagatattggtcgcgact

SEQ ID NO: 213014 - DNA, 25 bp, E. coli
tacgagaaagattttggtcgcgact

SEQ ID NO: 213015 - DNA, 25 bp, E. coli
tatggctgaagcgaaagcgcagaat

SEQ ID NO: 213016 - DNA, 25 bp, E. coli
tatggctgaagccaaagcgcagaat

SEQ ID NO: 213017 - DNA, 25 bp, E. coli
tccggcgaatatggctgaagcgaaa

SEQ ID NO: 213018 - DNA, 25 bp, E. coli
tccggcgaatatcgctgaagcgaaa

SEQ ID NO: 213019 - DNA, 25 bp, E. coli
tctgaagttcggttataaaggtgac

SEQ ID NO: 213020 - DNA, 25 bp, E. coli
tctgaagttcggatataaaggtgac

SEQ ID NO: 213021 - DNA, 25 bp, E. coli
gctgaatggtttcattctgaagttc

SEQ ID NO: 213022 - DNA, 25 bp, E. coli
gctgtctccggcgaatatggctgaa

SEQ ID NO: 213023 - DNA, 25 bp, E. coli
gctgtctccggccaatatggctgaa

SEQ ID NO: 213024 - DNA, 25 bp, E. coli
gctgaatggtttgattctgaagttc

SEQ ID NO: 213025 - DNA, 25 bp, E. coli
gaatactatcagcatgattttcatt

SEQ ID NO: 213026 - DNA, 25 bp, E. coli
gaatactatcaggatgattttcatt

SEQ ID NO: 213027 - DNA, 25 bp, E. coli
cgagcgtaaatgttcacaaatcatc

SEQ ID NO: 213028 - DNA, 25 bp, E. coli
cgagcgtaaatgatcacaaatcatc

SEQ ID NO: 213029 - DNA, 25 bp, E. coli
ctggaagggctgtatggtttgattc

SEQ ID NO: 213030 - DNA, 25 bp, E. coli
cgtgaagagtacgagaaagattttg

SEQ ID NO: 213031 - DNA, 25 bp, E. coli
cgtgaagagtaccagaaagattttg

SEQ ID NO: 213032 - DNA, 25 bp, E. coli
ctggaagggctgaatggtttgattc

SEQ ID NO: 213033 - DNA, 25 bp, E. coli
gttcacaaatcaactctcgcgccag

SEQ ID NO: 213034 - DNA, 25 bp, E. coli
gttcacaaatcatctctcgcgccag

SEQ ID NO: 213035 - DNA, 25 bp, E. coli
aacggttgctataatcgcagaaata

SEQ ID NO: 213036 - DNA, 25 bp, E. coli
cacgaaacggttcctattatcgcag

SEQ ID NO: 213037 - DNA, 25 bp, E. coli
cacgaaacggttgctattatcgcag

SEQ ID NO: 213038 - DNA, 25 bp, E. coli
catatttgacaaaaaactccgtgat

SEQ ID NO: 213039 - DNA, 25 bp, E. coli
catatttgacaataaactccgtgat

SEQ ID NO: 213040 - DNA, 25 bp, E. coli
cattttaggtgtcgaaaatgttctc

SEQ ID NO: 213041 - DNA, 25 bp, E. coli
cattttaggtgtggaaaatgttctc

SEQ ID NO: 213042 - DNA, 25 bp, E. coli
aacggttgctattatcgcagaaata

SEQ ID NO: 213043 - DNA, 25 bp, E. coli
tgattcctgtcaggaaacggttgct

SEQ ID NO: 213044 - DNA, 25 bp, E. coli
tgttaaccgcgacaaggctcataga

SEQ ID NO: 213045 - DNA, 25 bp, E. coli
tgttaaccgcgagaaggctcataga

SEQ ID NO: 213046 - DNA, 25 bp, E. coli
tgattcctgtcacgaaacggttgct

SEQ ID NO: 213047 - DNA, 25 bp, E. coli
tgacaaaaaactgcgtgattcctgt

SEQ ID NO: 213048 - DNA, 25 bp, E. coli
tgacaaaaaactccgtgattcctgt

SEQ ID NO: 213049 - DNA, 25 bp, E. coli
gcgacaaggctcttagatttacgta

SEQ ID NO: 213050 - DNA, 25 bp, E. coli
gcgacaaggctcatagatttacgta

SEQ ID NO: 213051 - DNA, 25 bp, E. coli
gctcatagattttcgtatctggaga

SEQ ID NO: 213052 - DNA, 25 bp, E. coli
gctcatagatttacgtatctggaga

SEQ ID NO: 213053 - DNA, 25 bp, E. coli
cgcagaaatagctttttaggtgtgg

SEQ ID NO: 213054 - DNA, 25 bp, E. coli
cgcagaaatagcattttaggtgtgg

SEQ ID NO: 213055 - DNA, 25 bp, E. coli
cgtatctggagatattcatatttga

SEQ ID NO: 213056 - DNA, 25 bp, E. coli
cgtatctggagaaattcatatttga

SEQ ID NO: 213057 - DNA, 25 bp, E. coli
caaatagttatcaacacaacgtcaa

SEQ ID NO: 213058 - DNA, 25 bp, E. coli
caaatagttatctacacaacgtcaa

SEQ ID NO: 213059 - DNA, 25 bp, E. coli
tactattcaccgatgcaggcgtttc

SEQ ID NO: 213060 - DNA, 25 bp, E. coli
tactattcaccgttgcaggcgtttc

SEQ ID NO: 213061 - DNA, 25 bp, E. coli
aactgatgatctattcacgtagaca

SEQ ID NO: 213062 - DNA, 25 bp, E. coli
aactgatgatcttttcacgtagaca

SEQ ID NO: 213063 - DNA, 25 bp, E. coli
tccccataaggcgagcgcctgtaag

SEQ ID NO: 213064 - DNA, 25 bp, E. coli
tgccgacacactgatattcagattg

SEQ ID NO: 213065 - DNA, 25 bp, E. coli
tgccgacacactcatattcagattg

SEQ ID NO: 213066 - DNA, 25 bp, E. coli
tccccataaggccagcgcctgtaag

SEQ ID NO: 213067 - DNA, 25 bp, E. coli
gcgcctgtaagtctgatatttgcta

SEQ ID NO: 213068 - DNA, 25 bp, E. coli
gcgcctgtaagtgtgatatttgcta

SEQ ID NO: 213069 - DNA, 25 bp, E. coli
ccgttgcaggcgattcaaatgcgca

SEQ ID NO: 213070 - DNA, 25 bp, E. coli
ccgttgcaggcgtttcaaatgcgca

SEQ ID NO: 213071 - DNA, 25 bp, E. coli
gctatctgtaaatgactaaaatcgg

SEQ ID NO: 213072 - DNA, 25 bp, E. coli
gctatctgtaaaagactaaaatcgg

SEQ ID NO: 213073 - DNA, 25 bp, E. coli
gactaaaatcggcaaaactgatgat

SEQ ID NO: 213074 - DNA, 25 bp, E. coli
gactaaaatcgggaaaactgatgat

SEQ ID NO: 213075 - DNA, 25 bp, E. coli
gataatgtccatttctgccgacaca

SEQ ID NO: 213076 - DNA, 25 bp, E. coli
gataatgtccatatctgccgacaca

SEQ ID NO: 213077 - DNA, 25 bp, E. coli
ggcttaaatctcttactattcaccg

SEQ ID NO: 213078 - DNA, 25 bp, E. coli
ggcttaaatctcatactattcaccg

SEQ ID NO: 213079 - DNA, 25 bp, E. coli
caggcgatttcctccgaggcttata

SEQ ID NO: 213080 - DNA, 25 bp, E. coli
caggcgatttccaccgaggcttata

SEQ ID NO: 213081 - DNA, 25 bp, E. coli
tacgggcgcacctaaaatcatcgtc

SEQ ID NO: 213082 - DNA, 25 bp, E. coli
agatctcgtcataggtacgggcgca

SEQ ID NO: 213083 - DNA, 25 bp, E. coli
agatctcgtcattggtacgggcgca

SEQ ID NO: 213084 - DNA, 25 bp, E. coli
tacgggcgcaccaaaaatcatcgtc

SEQ ID NO: 213085 - DNA, 25 bp, E. coli
tacgcccacgcggatgatgtgaaag

SEQ ID NO: 213086 - DNA, 25 bp, E. coli
tacgcccacgcgcatgatgtgaaag

SEQ ID NO: 213087 - DNA, 25 bp, E. coli
tattcctaagattgcgctgatgccg

SEQ ID NO: 213088 - DNA, 25 bp, E. coli
tattcctaagatagcgctgatgccg

SEQ ID NO: 213089 - DNA, 25 bp, E. coli
tgatgccgcaaagtaccagcgatgt

SEQ ID NO: 213090 - DNA, 25 bp, E. coli
tgatgccgcaaactaccagcgatgt

SEQ ID NO: 213091 - DNA, 25 bp, E. coli
tgcgccagggcatatctcggtaaat

SEQ ID NO: 213092 - DNA, 25 bp, E. coli
tgcgccagggcaaatctcggtaaat

SEQ ID NO: 213093 - DNA, 25 bp, E. coli
gctgtttaccttgcgcagtgccaaa

SEQ ID NO: 213094 - DNA, 25 bp, E. coli
gctgtttaccttccgcagtgccaaa

SEQ ID NO: 213095 - DNA, 25 bp, E. coli
gaagaaatcattccccgtctgcgca

SEQ ID NO: 213096 - DNA, 25 bp, E. coli
gaagaaatcattgcccgtctgcgca

SEQ ID NO: 213097 - DNA, 25 bp, E. coli
gaagctctcgcctatcgtgaagcgg

SEQ ID NO: 213098 - DNA, 25 bp, E. coli
gaagctctcgccaatcgtgaagcgg

SEQ ID NO: 213099 - DNA, 25 bp, E. coli
gatattctggaaaggcgtgtggacc

SEQ ID NO: 213100 - DNA, 25 bp, E. coli
gatattctggaatggcgtgtggacc

SEQ ID NO: 213101 - DNA, 25 bp, E. coli
cagacctttatcagcagcaactcaa

SEQ ID NO: 213102 - DNA, 25 bp, E. coli
cagacctttatctgcagcaactcaa

SEQ ID NO: 213103 - DNA, 25 bp, E. coli
tacaaggcgctctgaccttattcga

SEQ ID NO: 213104 - DNA, 25 bp, E. coli
tacaaggcgctcagaccttattcga

SEQ ID NO: 213105 - DNA, 25 bp, E. coli
taaaattgacctacaaggcgctcag

SEQ ID NO: 213106 - DNA, 25 bp, E. coli
taaaattgaccttcaaggcgctcag

SEQ ID NO: 213107 - DNA, 25 bp, E. coli
tatctgcagcaactcaagctggccc

SEQ ID NO: 213108 - DNA, 25 bp, E. coli
tatctgcagcaagtcaagctggccc

SEQ ID NO: 213109 - DNA, 25 bp, E. coli
tcaagctggcccaccgcacagaaaa

SEQ ID NO: 213110 - DNA, 25 bp, E. coli
tcaagctggccctccgcacagaaaa

SEQ ID NO: 213111 - DNA, 25 bp, E. coli
cctgcaacaactcatcgctaaaatt

SEQ ID NO: 213112 - DNA, 25 bp, E. coli
cctgcaacaactgatcgctaaaatt

SEQ ID NO: 213113 - DNA, 25 bp, E. coli
gaaaaaacgccggatcactgggatc

SEQ ID NO: 213114 - DNA, 25 bp, E. coli
gaaaaaacgccgcatcactgggatc

SEQ ID NO: 213115 - DNA, 25 bp, E. coli
cgcacagaaaaatcgccggatcact

SEQ ID NO: 213116 - DNA, 25 bp, E. coli
cgcacagaaaaaacgccggatcact

SEQ ID NO: 213117 - DNA, 25 bp, E. coli
gatcaacgggcgcaaaaaatggcgg

SEQ ID NO: 213118 - DNA, 25 bp, E. coli
tcactgggatcatcgggcggaaaaa

SEQ ID NO: 213119 - DNA, 25 bp, E. coli
tcactgggatcaacgggcggaaaaa

SEQ ID NO: 213120 - DNA, 25 bp, E. coli
gatcaacgggcggaaaaaatggcgg

SEQ ID NO: 213121 - DNA, 25 bp, E. coli
gatcgctaaaattgacctacaaggc

SEQ ID NO: 213122 - DNA, 25 bp, E. coli
gatcgctaaaatagacctacaaggc

SEQ ID NO: 213123 - DNA, 25 bp, E. coli
cagatggagtttaccgtacccggcg

SEQ ID NO: 213124 - DNA, 25 bp, E. coli
catatgccgaaacgcgatggcccgt

SEQ ID NO: 213125 - DNA, 25 bp, E. coli
catatgccgaaaggcgatggcccgt

SEQ ID NO: 213126 - DNA, 25 bp, E. coli
cagtcggcccttcatggtaaaacca

SEQ ID NO: 213127 - DNA, 25 bp, E. coli
cagatggagttttccgtacccggcg

SEQ ID NO: 213128 - DNA, 25 bp, E. coli
cagtcggcccttgatggtaaaacca

SEQ ID NO: 213129 - DNA, 25 bp, E. coli
cctaacgtaccgagggtggatcaca

SEQ ID NO: 213130 - DNA, 25 bp, E. coli
cctaacgtaccgtgggtggatcaca

SEQ ID NO: 213131 - DNA, 25 bp, E. coli
tatgaacgttatattgcgccgcgcg

SEQ ID NO: 213132 - DNA, 25 bp, E. coli
tatgaacgttattttgcgccgcgcg

SEQ ID NO: 213133 - DNA, 25 bp, E. coli
tagagatcccatttaacccggtgta

SEQ ID NO: 213134 - DNA, 25 bp, E. coli
tagagatcccatataacccggtgta

SEQ ID NO: 213135 - DNA, 25 bp, E. coli
tttaagtgccaggaacaggtgccgg

SEQ ID NO: 213136 - DNA, 25 bp, E. coli
tttaagtgccagcaacaggtgccgg

SEQ ID NO: 213137 - DNA, 25 bp, E. coli
tggtgtggcaactaaaagcctgtgc

SEQ ID NO: 213138 - DNA, 25 bp, E. coli
tggtgtggcaacaaaaagcctgtgc

SEQ ID NO: 213139 - DNA, 25 bp, E. coli
tctgaaaggagaagacctggccgag

SEQ ID NO: 213140 - DNA, 25 bp, E. coli
tcaggctactggtagaacgatccgt

SEQ ID NO: 213141 - DNA, 25 bp, E. coli
tctgaaaggagatgacctggccgag

SEQ ID NO: 213142 - DNA, 25 bp, E. coli
tcaggctactggaagaacgatccgt

SEQ ID NO: 213143 - DNA, 25 bp, E. coli
taaccgtctgatgtggatctggcgc

SEQ ID NO: 213144 - DNA, 25 bp, E. coli
taaccgtctgatctggatctggcgc

SEQ ID NO: 213145 - DNA, 25 bp, E. coli
atagcgcgtgaagccacagcctggt

SEQ ID NO: 213146 - DNA, 25 bp, E. coli
atagcgcgtgaacccacagcctggt

SEQ ID NO: 213147 - DNA, 25 bp, E. coli
atctggcggcgcaactggaggctat

SEQ ID NO: 213148 - DNA, 25 bp, E. coli
aggctatagcgcctgaagccacagc

SEQ ID NO: 213149 - DNA, 25 bp, E. coli
aggctatagcgcgtgaagccacagc

SEQ ID NO: 213150 - DNA, 25 bp, E. coli
atctggcggcgctactggaggctat

SEQ ID NO: 213151 - DNA, 25 bp, E. coli
actggaggctattgcgcgtgaagcc

SEQ ID NO: 213152 - DNA, 25 bp, E. coli
actggaggctatagcgcgtgaagcc

SEQ ID NO: 213153 - DNA, 25 bp, E. coli
tacgcgagtgggttagcgcaccacc

SEQ ID NO: 213154 - DNA, 25 bp, E. coli
tacgcgagtgggatagcgcaccacc

SEQ ID NO: 213155 - DNA, 25 bp, E. coli
tgaagccacagcctggtcgctacgc

SEQ ID NO: 213156 - DNA, 25 bp, E. coli
tgaagccacagcgtggtcgctacgc

SEQ ID NO: 213157 - DNA, 25 bp, E. coli
tcgctacgcgagtgggatagcgcac

SEQ ID NO: 213158 - DNA, 25 bp, E. coli
tcgctacgcgagagggatagcgcac

SEQ ID NO: 213159 - DNA, 25 bp, E. coli
ccacagcctggtcgctacgcgagtg

SEQ ID NO: 213160 - DNA, 25 bp, E. coli
ccacagcctggtggctacgcgagtg

SEQ ID NO: 213161 - DNA, 25 bp, E. coli
gcgtgaagccacagcctggtcgcta

SEQ ID NO: 213162 - DNA, 25 bp, E. coli
gcgtgaagccactgcctggtcgcta

SEQ ID NO: 213163 - DNA, 25 bp, E. coli
gcaactggaggcaatagcgcgtgaa

SEQ ID NO: 213164 - DNA, 25 bp, E. coli
gcaactggaggctatagcgcgtgaa

SEQ ID NO: 213165 - DNA, 25 bp, E. coli
ctacgcgagtgggatagcgcaccac

SEQ ID NO: 213166 - DNA, 25 bp, E. coli
ctacgcgagtggcatagcgcaccac

SEQ ID NO: 213167 - DNA, 25 bp, E. coli
aagtgatgggcatcagtgcgcagtt

SEQ ID NO: 213168 - DNA, 25 bp, E. coli
aagtgatgggcaacagtgcgcagtt

SEQ ID NO: 213169 - DNA, 25 bp, E. coli
cagcgtggcggcgaggttcatggcg

SEQ ID NO: 213170 - DNA, 25 bp, E. coli
cagcgtggcggccaggttcatggcg

SEQ ID NO: 213171 - DNA, 25 bp, E. coli
ctgggttttgccagtagtgggatcc

SEQ ID NO: 213172 - DNA, 25 bp, E. coli
acggatacggtttgtgctgtacggc

SEQ ID NO: 213173 - DNA, 25 bp, E. coli
ctgggttttgcctgtagtgggatcc

SEQ ID NO: 213174 - DNA, 25 bp, E. coli
acggatacggttagtgctgtacggc

SEQ ID NO: 213175 - DNA, 25 bp, E. coli
tatttgtgcttagggatacggtttg

SEQ ID NO: 213176 - DNA, 25 bp, E. coli
tatttgtgcttacggatacggtttg

SEQ ID NO: 213177 - DNA, 25 bp, E. coli
tgtgcttacggaaacggtttgtgct

SEQ ID NO: 213178 - DNA, 25 bp, E. coli
tgtgcttacggatacggtttgtgct

SEQ ID NO: 213179 - DNA, 25 bp, E. coli
ccagtagtgggaaccgtattgaagg

SEQ ID NO: 213180 - DNA, 25 bp, E. coli
ccagtagtgggatccgtattgaagg

SEQ ID NO: 213181 - DNA, 25 bp, E. coli
gttcacctccggagcacagcgtggc

SEQ ID NO: 213182 - DNA, 25 bp, E. coli
gttttgccagtagtgggatccgtat

SEQ ID NO: 213183 - DNA, 25 bp, E. coli
gttcacctccggtgcacagcgtggc

SEQ ID NO: 213184 - DNA, 25 bp, E. coli
gttttgccagtactgggatccgtat

SEQ ID NO: 213185 - DNA, 25 bp, E. coli
ggttcatggcgtatttgacgatccg

SEQ ID NO: 213186 - DNA, 25 bp, E. coli
ggttcatggcgtttttgacgatccg

SEQ ID NO: 213187 - DNA, 25 bp, E. coli
gatgggcatcagtgcgcagttcacc

SEQ ID NO: 213188 - DNA, 25 bp, E. coli
gatgggcatcagagcgcagttcacc

SEQ ID NO: 213189 - DNA, 25 bp, E. coli
tattgctgtagcgagtgatgtgccg

SEQ ID NO: 213190 - DNA, 25 bp, E. coli
tattgctgtagccagtgatgtgccg

SEQ ID NO: 213191 - DNA, 25 bp, E. coli
gctgtttcgcgatggagccggacat

SEQ ID NO: 213192 - DNA, 25 bp, E. coli
gcattatgcgcctgagggatccgtc

SEQ ID NO: 213193 - DNA, 25 bp, E. coli
gctgtttcgcgaaggagccggacat

SEQ ID NO: 213194 - DNA, 25 bp, E. coli
gcattatgcgccagagggatccgtc

SEQ ID NO: 213195 - DNA, 25 bp, E. coli
gaagaattagtgttagacaggcatg

SEQ ID NO: 213196 - DNA, 25 bp, E. coli
gaagaattagtgatagacaggcatg

SEQ ID NO: 213197 - DNA, 25 bp, E. coli
cgaagggtttaaccatgaagagatc

SEQ ID NO: 213198 - DNA, 25 bp, E. coli
cgaagggtttaagcatgaagagatc

SEQ ID NO: 213199 - DNA, 25 bp, E. coli
cggaaacaccagtcgaagaagagct

SEQ ID NO: 213200 - DNA, 25 bp, E. coli
cggaaacaccagacgaagaagagct

SEQ ID NO: 213201 - DNA, 25 bp, E. coli
gtcgaatggatacctcaaagctgga

SEQ ID NO: 213202 - DNA, 25 bp, E. coli
gtcgaatggatagctcaaagctgga

SEQ ID NO: 213203 - DNA, 25 bp, E. coli
ggctgattaagcatacgcaccatga

SEQ ID NO: 213204 - DNA, 25 bp, E. coli
ggctgattaagcttacgcaccatga

SEQ ID NO: 213205 - DNA, 25 bp, E. coli
gatgggccttgaagacggaaacacc

SEQ ID NO: 213206 - DNA, 25 bp, E. coli
gatcgcaaagatagtgctgtttcgc

SEQ ID NO: 213207 - DNA, 25 bp, E. coli
gatgtgccgctttatcttgatgtcg

SEQ ID NO: 213208 - DNA, 25 bp, E. coli
gatgtgccgcttaatcttgatgtcg

SEQ ID NO: 213209 - DNA, 25 bp, E. coli
gatcgcaaagattgtgctgtttcgc

SEQ ID NO: 213210 - DNA, 25 bp, E. coli
gatgggccttgatgacggaaacacc

SEQ ID NO: 213211 - DNA, 25 bp, E. coli
aatactttgagtacgcccatgacgg

SEQ ID NO: 213212 - DNA, 25 bp, E. coli
aatactttgagttcgcccatgacgg

SEQ ID NO: 213213 - DNA, 25 bp, E. coli
caggttgactacttatccggtccca

SEQ ID NO: 213214 - DNA, 25 bp, E. coli
caggttgactacatatccggtccca

SEQ ID NO: 213215 - DNA, 25 bp, E. coli
tcgcatgcgatgtcagaagtgatga

SEQ ID NO: 213216 - DNA, 25 bp, E. coli
tcgcatgcgatgacagaagtgatga

SEQ ID NO: 213217 - DNA, 25 bp, E. coli
gcaggttttacgaacccgccagtcg

SEQ ID NO: 213218 - DNA, 25 bp, E. coli
gcaggttttacgtacccgccagtcg

SEQ ID NO: 213219 - DNA, 25 bp, E. coli
gaatgcgctgtgaattgccgataac

SEQ ID NO: 213220 - DNA, 25 bp, E. coli
gaatgcgctgtgtattgccgataac

SEQ ID NO: 213221 - DNA, 25 bp, E. coli
cgcgtttcagtgttgtggtcagcca

SEQ ID NO: 213222 - DNA, 25 bp, E. coli
cgctgagtgtgcgtaagcttgccgc

SEQ ID NO: 213223 - DNA, 25 bp, E. coli
cgcgtttcagtgatgtggtcagcca

SEQ ID NO: 213224 - DNA, 25 bp, E. coli
cgctgagtgtgcctaagcttgccgc

SEQ ID NO: 213225 - DNA, 25 bp, E. coli
cgtggatatgcacgaaaaaaccgtc

SEQ ID NO: 213226 - DNA, 25 bp, E. coli
cgtggatatgcaggaaaaaaccgtc

SEQ ID NO: 213227 - DNA, 25 bp, E. coli
gataccctcgaaccctgacaatcag

SEQ ID NO: 213228 - DNA, 25 bp, E. coli
gataccctcgaagcctgacaatcag

SEQ ID NO: 213229 - DNA, 25 bp, E. coli
tggaataccaggaggtgacggaccc

SEQ ID NO: 213230 - DNA, 25 bp, E. coli
ggcagttactactacctcgtggata

SEQ ID NO: 213231 - DNA, 25 bp, E. coli
ggcagttactacaacctcgtggata

SEQ ID NO: 213232 - DNA, 25 bp, E. coli
tggaataccaggtggtgacggaccc

SEQ ID NO: 213233 - DNA, 25 bp, E. coli
aatccggttccttcgccttcaggag

SEQ ID NO: 213234 - DNA, 25 bp, E. coli
aatcagccgtctggttgcgggtgaa

SEQ ID NO: 213235 - DNA, 25 bp, E. coli
aatcagccgtctcgttgcgggtgaa

SEQ ID NO: 213236 - DNA, 25 bp, E. coli
aatccggttcctacgccttcaggag

SEQ ID NO: 213237 - DNA, 25 bp, E. coli
aacgttgagcgtccgcaaactggcg

SEQ ID NO: 213238 - DNA, 25 bp, E. coli
caggagacttttcgccgcaatgaca

SEQ ID NO: 213239 - DNA, 25 bp, E. coli
cagtgagatgcagatggtgcccgac

SEQ ID NO: 213240 - DNA, 25 bp, E. coli
cagtgagatgcacatggtgcccgac

SEQ ID NO: 213241 - DNA, 25 bp, E. coli
caggagacttttggccgcaatgaca

SEQ ID NO: 213242 - DNA, 25 bp, E. coli
aacgttgagcgtgcgcaaactggcg

SEQ ID NO: 213243 - DNA, 25 bp, E. coli
tatctggtggctcaacacgaagggc

SEQ ID NO: 213244 - DNA, 25 bp, E. coli
tatctggtggctgaacacgaagggc

SEQ ID NO: 213245 - DNA, 25 bp, E. coli
tgattcaggccattaccgggcgcag

SEQ ID NO: 213246 - DNA, 25 bp, E. coli
tgattcaggccaataccgggcgcag

SEQ ID NO: 213247 - DNA, 25 bp, E. coli
tctgattcagccattgcaggagact

SEQ ID NO: 213248 - DNA, 25 bp, E. coli
tctgattcagcctttgcaggagact

SEQ ID NO: 213249 - DNA, 25 bp, E. coli
cgatgagtctccctgcgtgatagca

SEQ ID NO: 213250 - DNA, 25 bp, E. coli
cgatgagtctccgtgcgtgatagca

SEQ ID NO: 213251 - DNA, 25 bp, E. coli
cgtgatagcacctgccaatccggtt

SEQ ID NO: 213252 - DNA, 25 bp, E. coli
cgtgatagcaccagccaatccggtt

SEQ ID NO: 213253 - DNA, 25 bp, E. coli
gatactgccgctaacgcactgctgg

SEQ ID NO: 213254 - DNA, 25 bp, E. coli
gatactgccgcttacgcactgctgg

SEQ ID NO: 213255 - DNA, 25 bp, E. coli
cagtttcagattcaacatattcagc

SEQ ID NO: 213256 - DNA, 25 bp, E. coli
cagtttcagattgaacatattcagc

SEQ ID NO: 213257 - DNA, 25 bp, E. coli
tactcagccagtatcagattgaaca

SEQ ID NO: 213258 - DNA, 25 bp, E. coli
tactcagccagtttcagattgaaca

SEQ ID NO: 213259 - DNA, 25 bp, E. coli
tacagtaccagaaactcagccagtt

SEQ ID NO: 213260 - DNA, 25 bp, E. coli
acatattcagctattcaaagagcaa

SEQ ID NO: 213261 - DNA, 25 bp, E. coli
acatattcagcttttcaaagagcaa

SEQ ID NO: 213262 - DNA, 25 bp, E. coli
tgttgtacagtaccagatactcagc

SEQ ID NO: 213263 - DNA, 25 bp, E. coli
tgtacagtaccacatactcagccag

SEQ ID NO: 213264 - DNA, 25 bp, E. coli
tgtacagtaccagatactcagccag

SEQ ID NO: 213265 - DNA, 25 bp, E. coli
tgttgtacagtagcagatactcagc

SEQ ID NO: 213266 - DNA, 25 bp, E. coli
tcagccagtttcagattgaacatat

SEQ ID NO: 213267 - DNA, 25 bp, E. coli
gaattttactgttgtacagtaccag

SEQ ID NO: 213268 - DNA, 25 bp, E. coli
gaattttactgtagtacagtaccag

SEQ ID NO: 213269 - DNA, 25 bp, E. coli
gaacatattcagctattcaaagagc

SEQ ID NO: 213270 - DNA, 25 bp, E. coli
gaacatattcaggtattcaaagagc

SEQ ID NO: 213271 - DNA, 25 bp, E. coli
gatactcagccagtttcagattgaa

SEQ ID NO: 213272 - DNA, 25 bp, E. coli
gtaccagatactgagccagtttcag

SEQ ID NO: 213273 - DNA, 25 bp, E. coli
gatactcagccactttcagattgaa

SEQ ID NO: 213274 - DNA, 25 bp, E. coli
gtaccagatactcagccagtttcag

SEQ ID NO: 213275 - DNA, 25 bp, E. coli
tcagccagtttctgattgaacatat

SEQ ID NO: 213276 - DNA, 25 bp, E. coli
tacagtaccagatactcagccagtt

SEQ ID NO: 213277 - DNA, 25 bp, E. coli
catctttggcaacctgatctcggtg

SEQ ID NO: 213278 - DNA, 25 bp, E. coli
catctttggcaagctgatctcggtg

SEQ ID NO: 213279 - DNA, 25 bp, E. coli
tttcggtggcgaagaatcacatcac

SEQ ID NO: 213280 - DNA, 25 bp, E. coli
tatcttcagcctgtggcagatgcct

SEQ ID NO: 213281 - DNA, 25 bp, E. coli
tatcttcagcctctggcagatgcct

SEQ ID NO: 213282 - DNA, 25 bp, E. coli
tatcgacagaaagatggaaaggacg

SEQ ID NO: 213283 - DNA, 25 bp, E. coli
tatcgacagaaacatggaaaggacg

SEQ ID NO: 213284 - DNA, 25 bp, E. coli
tttcggtggcgatgaatcacatcac

SEQ ID NO: 213285 - DNA, 25 bp, E. coli
tgtttaacaacttcatcgacaggga

SEQ ID NO: 213286 - DNA, 25 bp, E. coli
tgtttaacaactacatcgacaggga

SEQ ID NO: 213287 - DNA, 25 bp, E. coli
tgctgctgtggtatggcgcgaatcc

SEQ ID NO: 213288 - DNA, 25 bp, E. coli
tgctgctgtggtttggcgcgaatcc

SEQ ID NO: 213289 - DNA, 25 bp, E. coli
tgcaagtaacgataccaggcatcat

SEQ ID NO: 213290 - DNA, 25 bp, E. coli
tgcaagtaacgaaaccaggcatcat

SEQ ID NO: 213291 - DNA, 25 bp, E. coli
cctgtttatctagacgctggttggg

SEQ ID NO: 213292 - DNA, 25 bp, E. coli
cctgtttatctacacgctggttggg

SEQ ID NO: 213293 - DNA, 25 bp, E. coli
gtatatcatcgcctttgccgttgcc

SEQ ID NO: 213294 - DNA, 25 bp, E. coli
gtatatcatcgcgtttgccgttgcc

SEQ ID NO: 213295 - DNA, 25 bp, E. coli
tcaaagggcagcattgattatcccc

SEQ ID NO: 213296 - DNA, 25 bp, E. coli
tcaaagggcagctttgattatcccc

SEQ ID NO: 213297 - DNA, 25 bp, E. coli
gatctctcctgcagtctcgctggtg

SEQ ID NO: 213298 - DNA, 25 bp, E. coli
gatctctcctgctgtctcgctggtg

SEQ ID NO: 213299 - DNA, 25 bp, E. coli
aaggagttgctgaccatcgcggcat

SEQ ID NO: 213300 - DNA, 25 bp, E. coli
aaggagttgctgtccatcgcggcat

SEQ ID NO: 213301 - DNA, 25 bp, E. coli
catcttgccgttgagggaaaccacg

SEQ ID NO: 213302 - DNA, 25 bp, E. coli
catcttgccgttcagggaaaccacg

SEQ ID NO: 213303 - DNA, 25 bp, E. coli
acatagtcttctgcaccgagggcga

SEQ ID NO: 213304 - DNA, 25 bp, E. coli
acatagtcttctccaccgagggcga

SEQ ID NO: 213305 - DNA, 25 bp, E. coli
ttttacgttgttccagcgaagcgga

SEQ ID NO: 213306 - DNA, 25 bp, E. coli
ttttacgttgttgcagcgaagcgga

SEQ ID NO: 213307 - DNA, 25 bp, E. coli
tgagcggtatcggttttcggcagac

SEQ ID NO: 213308 - DNA, 25 bp, E. coli
tgagcggtatcgcttttcggcagac

SEQ ID NO: 213309 - DNA, 25 bp, E. coli
tcttcgaggtcatacatcagggcat

SEQ ID NO: 213310 - DNA, 25 bp, E. coli
tcttcgaggtcaaacatcagggcat

SEQ ID NO: 213311 - DNA, 25 bp, E. coli
ccagctgtttgatgtgggcggcttc

SEQ ID NO: 213312 - DNA, 25 bp, E. coli
ccagctgtttgaagtgggcggcttc

SEQ ID NO: 213313 - DNA, 25 bp, E. coli
gaacagcagttcagttccttccggg

SEQ ID NO: 213314 - DNA, 25 bp, E. coli
gaacagcagttctgttccttccggg

SEQ ID NO: 213315 - DNA, 25 bp, E. coli
cggaatagacggaatcgaacgcctg

SEQ ID NO: 213316 - DNA, 25 bp, E. coli
cggaatagacggtatcgaacgcctg

SEQ ID NO: 213317 - DNA, 25 bp, E. coli
gatttgccgtcaaagcccagctgtt

SEQ ID NO: 213318 - DNA, 25 bp, E. coli
gatttgccgtcatagcccagctgtt

SEQ ID NO: 213319 - DNA, 25 bp, E. coli
ggcgataccgatgaaacgctcggaa

SEQ ID NO: 213320 - DNA, 25 bp, E. coli
ggcgataccgatcaaacgctcggaa

SEQ ID NO: 213321 - DNA, 25 bp, E. coli
catgaccgtgttggaaaatgtggcc

SEQ ID NO: 213322 - DNA, 25 bp, E. coli
catgaccgtgttcgaaaatgtggcc

SEQ ID NO: 213323 - DNA, 25 bp, E. coli
tacaaaggcatgtcgctggagtcgg

SEQ ID NO: 213324 - DNA, 25 bp, E. coli
tacgaagagccgaaaaacctgtttg

SEQ ID NO: 213325 - DNA, 25 bp, E. coli
tacgaagagccgtaaaacctgtttg

SEQ ID NO: 213326 - DNA, 25 bp, E. coli
tacaaaggcatgacgctggagtcgg

SEQ ID NO: 213327 - DNA, 25 bp, E. coli
aaaactgcatgttctgctgcgcccg

SEQ ID NO: 213328 - DNA, 25 bp, E. coli
aaaactgcatgtactgctgcgcccg

SEQ ID NO: 213329 - DNA, 25 bp, E. coli
gcatcagctctcaggtggtcaacag

SEQ ID NO: 213330 - DNA, 25 bp, E. coli
gctgcgcccggaagacttacgtgtt

SEQ ID NO: 213331 - DNA, 25 bp, E. coli
gctgcgcccggatgacttacgtgtt

SEQ ID NO: 213332 - DNA, 25 bp, E. coli
gcatcagctctctggtggtcaacag

SEQ ID NO: 213333 - DNA, 25 bp, E. coli
gaaggccgcgaaagtaatatctacg

SEQ ID NO: 213334 - DNA, 25 bp, E. coli
gaaggccgcgaatgtaatatctacg

SEQ ID NO: 213335 - DNA, 25 bp, E. coli
gaaactgttgattccggacgcatca

SEQ ID NO: 213336 - DNA, 25 bp, E. coli
gaaactgttgataccggacgcatca

SEQ ID NO: 213337 - DNA, 25 bp, E. coli
cgagttcgctttgaccgctggtgca

SEQ ID NO: 213338 - DNA, 25 bp, E. coli
cgagttcgctttcaccgctggtgca

SEQ ID NO: 213339 - DNA, 25 bp, E. coli
ggtaaagaggtcattccccagctgg

SEQ ID NO: 213340 - DNA, 25 bp, E. coli
ggtaaagaggtctttccccagctgg

SEQ ID NO: 213341 - DNA, 25 bp, E. coli
ggcacgccgcgtgaaatctacgaag

SEQ ID NO: 213342 - DNA, 25 bp, E. coli
ggcacgccgcgtcaaatctacgaag

SEQ ID NO: 213343 - DNA, 25 bp, E. coli
catgtcgctgttattccggccctgg

SEQ ID NO: 213344 - DNA, 25 bp, E. coli
catgtcgctgtttttccggccctgg

SEQ ID NO: 213345 - DNA, 25 bp, E. coli
tacaccgtggcatgaattctggcga

SEQ ID NO: 213346 - DNA, 25 bp, E. coli
tacaccgtggcaagaattctggcga

SEQ ID NO: 213347 - DNA, 25 bp, E. coli
agccgtgtcctggttggtgcgcaaa

SEQ ID NO: 213348 - DNA, 25 bp, E. coli
agccgtgtcctgcttggtgcgcaaa

SEQ ID NO: 213349 - DNA, 25 bp, E. coli
tacgcgatgcgctggatccgaaaat

SEQ ID NO: 213350 - DNA, 25 bp, E. coli
tacgcgatgcgcaggatccgaaaat

SEQ ID NO: 213351 - DNA, 25 bp, E. coli
gactatttaactcgcgacgtcaggc

SEQ ID NO: 213352 - DNA, 25 bp, E. coli
gactatttaactggcgacgtcaggc

SEQ ID NO: 213353 - DNA, 25 bp, E. coli
cccgggtatttttctggcgatcgct

SEQ ID NO: 213354 - DNA, 25 bp, E. coli
cccgggtattttactggcgatcgct

SEQ ID NO: 213355 - DNA, 25 bp, E. coli
gatcggctgatcatgcgcatttgcg

SEQ ID NO: 213356 - DNA, 25 bp, E. coli
gatcggctgatcttgcgcatttgcg

SEQ ID NO: 213357 - DNA, 25 bp, E. coli
ggatatggttatggcgccgcatgtc

SEQ ID NO: 213358 - DNA, 25 bp, E. coli
ggatatggttatcgcgccgcatgtc

SEQ ID NO: 213359 - DNA, 25 bp, E. coli
tggatcgctcccaatgacgccgaaa

SEQ ID NO: 213360 - DNA, 25 bp, E. coli
tggatcgctccctatgacgccgaaa

SEQ ID NO: 213361 - DNA, 25 bp, E. coli
taacggaccttcattgcagcactgg

SEQ ID NO: 213362 - DNA, 25 bp, E. coli
tcagcacgcagtattggtgccagcg

SEQ ID NO: 213363 - DNA, 25 bp, E. coli
tcagcacgcagttttggtgccagcg

SEQ ID NO: 213364 - DNA, 25 bp, E. coli
taacggaccttctttgcagcactgg

SEQ ID NO: 213365 - DNA, 25 bp, E. coli
aattcacccgaatagaagccatctt

SEQ ID NO: 213366 - DNA, 25 bp, E. coli
aattcacccgaaaagaagccatctt

SEQ ID NO: 213367 - DNA, 25 bp, E. coli
aatgtacttgctgagccgtcaataa

SEQ ID NO: 213368 - DNA, 25 bp, E. coli
aatgtacttgctcagccgtcaataa

SEQ ID NO: 213369 - DNA, 25 bp, E. coli
tgaactgcggagagtattatctgca

SEQ ID NO: 213370 - DNA, 25 bp, E. coli
tgaactgcggagtgtattatctgca

SEQ ID NO: 213371 - DNA, 25 bp, E. coli
gccgtcaataaataagagctggaat

SEQ ID NO: 213372 - DNA, 25 bp, E. coli
gccgtcaataaaaaagagctggaat

SEQ ID NO: 213373 - DNA, 25 bp, E. coli
gcagaaattgtctccaccaatgacg

SEQ ID NO: 213374 - DNA, 25 bp, E. coli
gcagaaattgtcaccaccaatgacg

SEQ ID NO: 213375 - DNA, 25 bp, E. coli
gaatccaaccggaaaatatgagtcc

SEQ ID NO: 213376 - DNA, 25 bp, E. coli
gaatccaaccggtaaatatgagtcc

SEQ ID NO: 213377 - DNA, 25 bp, E. coli
tggacggtaaaatgaaagtttgcag

SEQ ID NO: 213378 - DNA, 25 bp, E. coli
tggacggtaaaaagaaagtttgcag

SEQ ID NO: 213379 - DNA, 25 bp, E. coli
taagtattgtgcaaaattcacccga

SEQ ID NO: 213380 - DNA, 25 bp, E. coli
taagtattgtgctaaattcacccga

SEQ ID NO: 213381 - DNA, 25 bp, E. coli
gatgttccttctctcatgatccgaa

SEQ ID NO: 213382 - DNA, 25 bp, E. coli
gagctggaatgttttaaggagacga

SEQ ID NO: 213383 - DNA, 25 bp, E. coli
gatgttccttctgtcatgatccgaa

SEQ ID NO: 213384 - DNA, 25 bp, E. coli
gatgtaggcactattgcaccttttg

SEQ ID NO: 213385 - DNA, 25 bp, E. coli
gagctggaatgtattaaggagacga

SEQ ID NO: 213386 - DNA, 25 bp, E. coli
gatgtaggcacttttgcaccttttg

SEQ ID NO: 213387 - DNA, 25 bp, E. coli
caggtgtgaccttaagttgggagaa

SEQ ID NO: 213388 - DNA, 25 bp, E. coli
cattacgataaccacatctattgcg

SEQ ID NO: 213389 - DNA, 25 bp, E. coli
cagtccgcaattgctgctgacaagt

SEQ ID NO: 213390 - DNA, 25 bp, E. coli
caggtgtgacctaaagttgggagaa

SEQ ID NO: 213391 - DNA, 25 bp, E. coli
cagtccgcaattcctgctgacaagt

SEQ ID NO: 213392 - DNA, 25 bp, E. coli
acgataaccacaactattgcgcctg

SEQ ID NO: 213393 - DNA, 25 bp, E. coli
acgataaccacatctattgcgcctg

SEQ ID NO: 213394 - DNA, 25 bp, E. coli
acaggtgtgaccataagttgggaga

SEQ ID NO: 213395 - DNA, 25 bp, E. coli
acaggtgtgaccttaagttgggaga

SEQ ID NO: 213396 - DNA, 25 bp, E. coli
ttacgataaccacatctattgcgcc

SEQ ID NO: 213397 - DNA, 25 bp, E. coli
ttacgataaccagatctattgcgcc

SEQ ID NO: 213398 - DNA, 25 bp, E. coli
cggttgggtcattacgataaccaca

SEQ ID NO: 213399 - DNA, 25 bp, E. coli
cggttgggtcataacgataaccaca

SEQ ID NO: 213400 - DNA, 25 bp, E. coli
cattacgataacgacatctattgcg

SEQ ID NO: 213401 - DNA, 25 bp, E. coli
tgggtcattacgataaccacatcta

SEQ ID NO: 213402 - DNA, 25 bp, E. coli
tgggtcattacgttaaccacatcta

SEQ ID NO: 213403 - DNA, 25 bp, E. coli
gggtcattacgataaccacatctat

SEQ ID NO: 213404 - DNA, 25 bp, E. coli
gggtcattacgaaaaccacatctat

SEQ ID NO: 213405 - DNA, 25 bp, E. coli
gttgggtcattaggataaccacatc

SEQ ID NO: 213406 - DNA, 25 bp, E. coli
gttgggtcattacgataaccacatc

SEQ ID NO: 213407 - DNA, 25 bp, E. coli
gtgtgaccttaagttgggagaatac

SEQ ID NO: 213408 - DNA, 25 bp, E. coli
gtgtgaccttaacttgggagaatac

SEQ ID NO: 213409 - DNA, 25 bp, E. coli
aacgattcggttttttctactcctg

SEQ ID NO: 213410 - DNA, 25 bp, E. coli
tactggaagccaatatcgtactgca

SEQ ID NO: 213411 - DNA, 25 bp, E. coli
tactggaagccattatcgtactgca

SEQ ID NO: 213412 - DNA, 25 bp, E. coli
actgcaatttactatgactcgttaa

SEQ ID NO: 213413 - DNA, 25 bp, E. coli
actcatgcaaaaaggcttccagtac

SEQ ID NO: 213414 - DNA, 25 bp, E. coli
actgcaatttacaatgactcgttaa

SEQ ID NO: 213415 - DNA, 25 bp, E. coli
actcatgcaaaatggcttccagtac

SEQ ID NO: 213416 - DNA, 25 bp, E. coli
aacgattcggttatttctactcctg

SEQ ID NO: 213417 - DNA, 25 bp, E. coli
tatttctactccagaagatctgctt

SEQ ID NO: 213418 - DNA, 25 bp, E. coli
tatttctactcctgaagatctgctt

SEQ ID NO: 213419 - DNA, 25 bp, E. coli
tctggcactcatgcaaaatggcttc

SEQ ID NO: 213420 - DNA, 25 bp, E. coli
tcgtactgcaatttacaatgactcg

SEQ ID NO: 213421 - DNA, 25 bp, E. coli
tcgtactgcaatatacaatgactcg

SEQ ID NO: 213422 - DNA, 25 bp, E. coli
tctggcactcatccaaaatggcttc

SEQ ID NO: 213423 - DNA, 25 bp, E. coli
gcttcaatctgggactcatgcaaaa

SEQ ID NO: 213424 - DNA, 25 bp, E. coli
gcttcaatctggcactcatgcaaaa

SEQ ID NO: 213425 - DNA, 25 bp, E. coli
gaagccattatcgtactgcaattta

SEQ ID NO: 213426 - DNA, 25 bp, E. coli
gaagatctgcttcaatctggcactc

SEQ ID NO: 213427 - DNA, 25 bp, E. coli
gaagatctgcttgaatctggcactc

SEQ ID NO: 213428 - DNA, 25 bp, E. coli
gaagccattatcctactgcaattta

SEQ ID NO: 213429 - DNA, 25 bp, E. coli
ggcactcatgcataatggcttccag

SEQ ID NO: 213430 - DNA, 25 bp, E. coli
ggcactcatgcaaaatggcttccag

SEQ ID NO: 213431 - DNA, 25 bp, E. coli
aagaagcgctgcatcttggcgggca

SEQ ID NO: 213432 - DNA, 25 bp, E. coli
aagaagcgctgcttcttggcgggca

SEQ ID NO: 213433 - DNA, 25 bp, E. coli
caccgcgtttgaaattgcctggaca

SEQ ID NO: 213434 - DNA, 25 bp, E. coli
caccgcgtttgatattgcctggaca

SEQ ID NO: 213435 - DNA, 25 bp, E. coli
caggcagagttaggcgtcattcaaa

SEQ ID NO: 213436 - DNA, 25 bp, E. coli
caggcagagttacgcgtcattcaaa

SEQ ID NO: 213437 - DNA, 25 bp, E. coli
taccggcagcaatgagtacgcgatg

SEQ ID NO: 213438 - DNA, 25 bp, E. coli
taccggcagcaaagagtacgcgatg

SEQ ID NO: 213439 - DNA, 25 bp, E. coli
tattaaatccctcagcgaagccggg

SEQ ID NO: 213440 - DNA, 25 bp, E. coli
tattgcggtaacgatgggtgacccg

SEQ ID NO: 213441 - DNA, 25 bp, E. coli
tatcaaacgtgcaacggctctggcc

SEQ ID NO: 213442 - DNA, 25 bp, E. coli
tattgcggtaaccatgggtgacccg

SEQ ID NO: 213443 - DNA, 25 bp, E. coli
tatcaaacgtgctacggctctggcc

SEQ ID NO: 213444 - DNA, 25 bp, E. coli
tattaaatccctgagcgaagccggg

SEQ ID NO: 213445 - DNA, 25 bp, E. coli
tgattaacgtgaaggatgagccgct

SEQ ID NO: 213446 - DNA, 25 bp, E. coli
tgattaacgtgatggatgagccgct

SEQ ID NO: 213447 - DNA, 25 bp, E. coli
tcattcaaaaggagtgcgacgccca

SEQ ID NO: 213448 - DNA, 25 bp, E. coli
tcattcaaaaggtgtgcgacgccca

SEQ ID NO: 213449 - DNA, 25 bp, E. coli
gaaatcgagattatcgcgcctgcga

SEQ ID NO: 213450 - DNA, 25 bp, E. coli
gaaatcgagattttcgcgcctgcga

SEQ ID NO: 213451 - DNA, 25 bp, E. coli
gatattgatgttactggcccgtgcc

SEQ ID NO: 213452 - DNA, 25 bp, E. coli
gatattgatgtttctggcccgtgcc

SEQ ID NO: 213453 - DNA, 25 bp, E. coli
aatcgttaatgggtgtcgtaccggc

SEQ ID NO: 213454 - DNA, 25 bp, E. coli
cagggatcaataagggaaccggcaa

SEQ ID NO: 213455 - DNA, 25 bp, E. coli
cagggatcaatatgggaaccggcaa

SEQ ID NO: 213456 - DNA, 25 bp, E. coli
taaacaatacagagccgaagtcgct

SEQ ID NO: 213457 - DNA, 25 bp, E. coli
taaacaatacagtgccgaagtcgct

SEQ ID NO: 213458 - DNA, 25 bp, E. coli
aatcgttaatggctgtcgtaccggc

SEQ ID NO: 213459 - DNA, 25 bp, E. coli
tatattgcccagtgaagtgttcagg

SEQ ID NO: 213460 - DNA, 25 bp, E. coli
tatattgcccagagaagtgttcagg

SEQ ID NO: 213461 - DNA, 25 bp, E. coli
tttaaagaaacacaactcacggatg

SEQ ID NO: 213462 - DNA, 25 bp, E. coli
tttaaagaaacagaactcacggatg

SEQ ID NO: 213463 - DNA, 25 bp, E. coli
tgcacaaaatgccacagggaactgg

SEQ ID NO: 213464 - DNA, 25 bp, E. coli
tgcacaaaatgcgacagggaactgg

SEQ ID NO: 213465 - DNA, 25 bp, E. coli
gacatgattagttcagatgacgcct

SEQ ID NO: 213466 - DNA, 25 bp, E. coli
gacatgattagtacagatgacgcct

SEQ ID NO: 213467 - DNA, 25 bp, E. coli
cgttaataagtaccaaagcggcatt

SEQ ID NO: 213468 - DNA, 25 bp, E. coli
cgttaataagtagcaaagcggcatt

SEQ ID NO: 213469 - DNA, 25 bp, E. coli
ctcacggatgtagggattggtcaat

SEQ ID NO: 213470 - DNA, 25 bp, E. coli
ctcacggatgtacggattggtcaat

SEQ ID NO: 213471 - DNA, 25 bp, E. coli
tggttggcgcttaaacgtacggata

SEQ ID NO: 213472 - DNA, 25 bp, E. coli
tggttggcgctttaacgtacggata

SEQ ID NO: 213473 - DNA, 25 bp, E. coli
tcaaaatcgttctgcgtgtaccggt

SEQ ID NO: 213474 - DNA, 25 bp, E. coli
tcaaaatcgttcagcgtgtaccggt

SEQ ID NO: 213475 - DNA, 25 bp, E. coli
caattcaccttcttttttagatgta

SEQ ID NO: 213476 - DNA, 25 bp, E. coli
caattcaccttcatttttagatgta

SEQ ID NO: 213477 - DNA, 25 bp, E. coli
cacctcatttttggcttaagtgtaa

SEQ ID NO: 213478 - DNA, 25 bp, E. coli
cacctcatttttcgcttaagtgtaa

SEQ ID NO: 213479 - DNA, 25 bp, E. coli
aaattttatcgtatgtcagcctgcg

SEQ ID NO: 213480 - DNA, 25 bp, E. coli
aaattttatcgtttgtcagcctgcg

SEQ ID NO: 213481 - DNA, 25 bp, E. coli
tatcgtttgtcagcctgcgttgttt

SEQ ID NO: 213482 - DNA, 25 bp, E. coli
tatcgtttgtcaccctgcgttgttt

SEQ ID NO: 213483 - DNA, 25 bp, E. coli
tttgtccaatatcatcaggttaatc

SEQ ID NO: 213484 - DNA, 25 bp, E. coli
tttgtccaatatgatcaggttaatc

SEQ ID NO: 213485 - DNA, 25 bp, E. coli
cctcatgtgaaaggcaaattttatc

SEQ ID NO: 213486 - DNA, 25 bp, E. coli
cctcatgtgaaacgcaaattttatc

SEQ ID NO: 213487 - DNA, 25 bp, E. coli
gcggcaaaatttgagctatgagatg

SEQ ID NO: 213488 - DNA, 25 bp, E. coli
gcggcaaaatttcagctatgagatg

SEQ ID NO: 213489 - DNA, 25 bp, E. coli
gctaaagtgaaccatatctcaattc

SEQ ID NO: 213490 - DNA, 25 bp, E. coli
gctaaagtgaacgatatctcaattc

SEQ ID NO: 213491 - DNA, 25 bp, E. coli
ctatgagatgagctaaagtgaacca

SEQ ID NO: 213492 - DNA, 25 bp, E. coli
ctatgagatgaggtaaagtgaacca

SEQ ID NO: 213493 - DNA, 25 bp, E. coli
gatgtaaatcacaccattgatgcaa

SEQ ID NO: 213494 - DNA, 25 bp, E. coli
gatgcaatttacctcatgtgaaagg

SEQ ID NO: 213495 - DNA, 25 bp, E. coli
gatgtaaatcactccattgatgcaa

SEQ ID NO: 213496 - DNA, 25 bp, E. coli
gatgcaatttacgtcatgtgaaagg

SEQ ID NO: 213497 - DNA, 25 bp, E. coli
catatcgcacaagatagagagcagc

SEQ ID NO: 213498 - DNA, 25 bp, E. coli
catatcgcacaacatagagagcagc

SEQ ID NO: 213499 - DNA, 25 bp, E. coli
tttgttgttgaccatatcgcacaac

SEQ ID NO: 213500 - DNA, 25 bp, E. coli
tatcgcacaacaaagagagcagcat

SEQ ID NO: 213501 - DNA, 25 bp, E. coli
tatcgcacaacatagagagcagcat

SEQ ID NO: 213502 - DNA, 25 bp, E. coli
tttgttgttgacgatatcgcacaac

SEQ ID NO: 213503 - DNA, 25 bp, E. coli
tgttgaccatatggcacaacataga

SEQ ID NO: 213504 - DNA, 25 bp, E. coli
tgttgaccatatcgcacaacataga

SEQ ID NO: 213505 - DNA, 25 bp, E. coli
tgaccatatcgctcaacatagagag

SEQ ID NO: 213506 - DNA, 25 bp, E. coli
tgaccatatcgcacaacatagagag

SEQ ID NO: 213507 - DNA, 25 bp, E. coli
tcgcacaacatagagagcagcatta

SEQ ID NO: 213508 - DNA, 25 bp, E. coli
tcgcacaacatacagagcagcatta

SEQ ID NO: 213509 - DNA, 25 bp, E. coli
ccatatcgcacaacatagagagcag

SEQ ID NO: 213510 - DNA, 25 bp, E. coli
ccatatcgcacatcatagagagcag

SEQ ID NO: 213511 - DNA, 25 bp, E. coli
cgcacaacatagagagcagcattaa

SEQ ID NO: 213512 - DNA, 25 bp, E. coli
cgcacaacatagtgagcagcattaa

SEQ ID NO: 213513 - DNA, 25 bp, E. coli
gttgttgaccatatcgcacaacata

SEQ ID NO: 213514 - DNA, 25 bp, E. coli
gttgttgaccatttcgcacaacata

SEQ ID NO: 213515 - DNA, 25 bp, E. coli
ggtttgttgttgaccatatcgcaca

SEQ ID NO: 213516 - DNA, 25 bp, E. coli
ggtttgttgttgtccatatcgcaca

SEQ ID NO: 213517 - DNA, 25 bp, E. coli
gaccatatcgcagaacatagagagc

SEQ ID NO: 213518 - DNA, 25 bp, E. coli
gaccatatcgcacaacatagagagc

SEQ ID NO: 213519 - DNA, 25 bp, E. coli
aaccgtcttgggtttgggcaactga

SEQ ID NO: 213520 - DNA, 25 bp, E. coli
aagagtgcaccaatatctacgcgcc

SEQ ID NO: 213521 - DNA, 25 bp, E. coli
aagagtgcaccattatctacgcgcc

SEQ ID NO: 213522 - DNA, 25 bp, E. coli
agtgcaccaataactacgcgccgtt

SEQ ID NO: 213523 - DNA, 25 bp, E. coli
agtgcaccaatatctacgcgccgtt

SEQ ID NO: 213524 - DNA, 25 bp, E. coli
aacactatatcgaagagtttgtcgg

SEQ ID NO: 213525 - DNA, 25 bp, E. coli
aaccgtcttgggattgggcaactga

SEQ ID NO: 213526 - DNA, 25 bp, E. coli
aacactatatcgtagagtttgtcgg

SEQ ID NO: 213527 - DNA, 25 bp, E. coli
aaaagagtgcaccaatatctacgcg

SEQ ID NO: 213528 - DNA, 25 bp, E. coli
aaaagagtgcacgaatatctacgcg

SEQ ID NO: 213529 - DNA, 25 bp, E. coli
tgggcaactgaaatgggagctggaa

SEQ ID NO: 213530 - DNA, 25 bp, E. coli
tgggcaactgaattgggagctggaa

SEQ ID NO: 213531 - DNA, 25 bp, E. coli
ccgaccgaatacaaacgcatcgcaa

SEQ ID NO: 213532 - DNA, 25 bp, E. coli
cgaacactatatggaagagtttgtc

SEQ ID NO: 213533 - DNA, 25 bp, E. coli
ccgaccgaatactaacgcatcgcaa

SEQ ID NO: 213534 - DNA, 25 bp, E. coli
cgaacactatatcgaagagtttgtc

SEQ ID NO: 213535 - DNA, 25 bp, E. coli
cgaatacaaacgcatcgcaaaactg

SEQ ID NO: 213536 - DNA, 25 bp, E. coli
cgaatacaaacggatcgcaaaactg

SEQ ID NO: 213537 - DNA, 25 bp, E. coli
cgtcttgggattcggcaactgaaat

SEQ ID NO: 213538 - DNA, 25 bp, E. coli
cgtcttgggattgggcaactgaaat

SEQ ID NO: 213539 - DNA, 25 bp, E. coli
gagtgcaccaatttctacgcgccgt

SEQ ID NO: 213540 - DNA, 25 bp, E. coli
gagtgcaccaatatctacgcgccgt

SEQ ID NO: 213541 - DNA, 25 bp, E. coli
caatagccgtgaattggctgccagt

SEQ ID NO: 213542 - DNA, 25 bp, E. coli
caatagccgtgatttggctgccagt

SEQ ID NO: 213543 - DNA, 25 bp, E. coli
taaaccattatacttagcgtgaata

SEQ ID NO: 213544 - DNA, 25 bp, E. coli
taaaccattatagttagcgtgaata

SEQ ID NO: 213545 - DNA, 25 bp, E. coli
tagcgtgaataactagtttaccgcg

SEQ ID NO: 213546 - DNA, 25 bp, E. coli
tagcgtgaataagtagtttaccgcg

SEQ ID NO: 213547 - DNA, 25 bp, E. coli
tagtgcgaaggctcactctattcgt

SEQ ID NO: 213548 - DNA, 25 bp, E. coli
tagtgcgaaggcacactctattcgt

SEQ ID NO: 213549 - DNA, 25 bp, E. coli
tttaccgcgttgacaggtgagcgcc

SEQ ID NO: 213550 - DNA, 25 bp, E. coli
tttaccgcgttgtcaggtgagcgcc

SEQ ID NO: 213551 - DNA, 25 bp, E. coli
tgaaattggttaaccaatagccgtg

SEQ ID NO: 213552 - DNA, 25 bp, E. coli
tgaaattggttatccaatagccgtg

SEQ ID NO: 213553 - DNA, 25 bp, E. coli
tcaggtgagcgcgtatcattgctgt

SEQ ID NO: 213554 - DNA, 25 bp, E. coli
tcaggtgagcgcctatcattgctgt

SEQ ID NO: 213555 - DNA, 25 bp, E. coli
gccagttatttagcagagacgttga

SEQ ID NO: 213556 - DNA, 25 bp, E. coli
gccagttatttaccagagacgttga

SEQ ID NO: 213557 - DNA, 25 bp, E. coli
cattgctgttgattagtgcgaaggc

SEQ ID NO: 213558 - DNA, 25 bp, E. coli
cgtatacttttcactctgaaattgg

SEQ ID NO: 213559 - DNA, 25 bp, E. coli
cgtatacttttctctctgaaattgg

SEQ ID NO: 213560 - DNA, 25 bp, E. coli
cattgctgttgaatagtgcgaaggc

SEQ ID NO: 213561 - DNA, 25 bp, E. coli
gagacgttgatgtgtttatcccggt

SEQ ID NO: 213562 - DNA, 25 bp, E. coli
gagacgttgatgagtttatcccggt

SEQ ID NO: 213563 - DNA, 25 bp, E. coli
cagaccccggaataagagacagaag

SEQ ID NO: 213564 - DNA, 25 bp, E. coli
cagaccccggaaaaagagacagaag

SEQ ID NO: 213565 - DNA, 25 bp, E. coli
tagaggcactttatgcccgagagga

SEQ ID NO: 213566 - DNA, 25 bp, E. coli
tagaagaaatcgatcaggcgcaaga

SEQ ID NO: 213567 - DNA, 25 bp, E. coli
tagaggcactttttgcccgagagga

SEQ ID NO: 213568 - DNA, 25 bp, E. coli
tagaagaaatcgttcaggcgcaaga

SEQ ID NO: 213569 - DNA, 25 bp, E. coli
tttggtcaaaaagagcagaccccgg

SEQ ID NO: 213570 - DNA, 25 bp, E. coli
tttggtcaaaaacagcagaccccgg

SEQ ID NO: 213571 - DNA, 25 bp, E. coli
ttctggcgaaagacgatgagccgct

SEQ ID NO: 213572 - DNA, 25 bp, E. coli
ttctggcgaaagtcgatgagccgct

SEQ ID NO: 213573 - DNA, 25 bp, E. coli
tccgcgtgatgatgaaactcgacgt

SEQ ID NO: 213574 - DNA, 25 bp, E. coli
tcgtagaagaaaggccggagccagt

SEQ ID NO: 213575 - DNA, 25 bp, E. coli
tcgtagaagaaacgccggagccagt

SEQ ID NO: 213576 - DNA, 25 bp, E. coli
tcgctcaggagcaggaaaaaccgac

SEQ ID NO: 213577 - DNA, 25 bp, E. coli
tccgcgtgatgaagaaactcgacgt

SEQ ID NO: 213578 - DNA, 25 bp, E. coli
tcgctcaggagctggaaaaaccgac

SEQ ID NO: 213579 - DNA, 25 bp, E. coli
gcatcacgctaacgaaactggacgg

SEQ ID NO: 213580 - DNA, 25 bp, E. coli
gcatcacgctaaggaaactggacgg

SEQ ID NO: 213581 - DNA, 25 bp, E. coli
gagttgaagaaattcgtccgcgtga

SEQ ID NO: 213582 - DNA, 25 bp, E. coli
gagttgaagaaaatcgtccgcgtga

SEQ ID NO: 213583 - DNA, 25 bp, E. coli
gagccagtggctttcgaacgtgaag

SEQ ID NO: 213584 - DNA, 25 bp, E. coli
gagccagtggctatcgaacgtgaag

SEQ ID NO: 213585 - DNA, 25 bp, E. coli
aaatgttgtcgatatcgctgcgccg

SEQ ID NO: 213586 - DNA, 25 bp, E. coli
aaatgttgtcgaaatcgctgcgccg

SEQ ID NO: 213587 - DNA, 25 bp, E. coli
taccgtgtaccagttaaagagggcg

SEQ ID NO: 213588 - DNA, 25 bp, E. coli
taccgtgtaccacttaaagagggcg

SEQ ID NO: 213589 - DNA, 25 bp, E. coli
tattttacaacatcggcggagaagc

SEQ ID NO: 213590 - DNA, 25 bp, E. coli
tattttacaacaacggcggagaagc

SEQ ID NO: 213591 - DNA, 25 bp, E. coli
tttcgacaacatgaaagcgcgctgt

SEQ ID NO: 213592 - DNA, 25 bp, E. coli
tttcgacaacatcaaagcgcgctgt

SEQ ID NO: 213593 - DNA, 25 bp, E. coli
tgatcaggtcaataaactccaggcg

SEQ ID NO: 213594 - DNA, 25 bp, E. coli
tgatcaggtcaaaaaactccaggcg

SEQ ID NO: 213595 - DNA, 25 bp, E. coli
tgaccgcgcgcatgaaatattttac

SEQ ID NO: 213596 - DNA, 25 bp, E. coli
tgaccgcgcgcaagaaatattttac

SEQ ID NO: 213597 - DNA, 25 bp, E. coli
tcaggatgcggaagaattactcggc

SEQ ID NO: 213598 - DNA, 25 bp, E. coli
tcaggatgcggatgaattactcggc

SEQ ID NO: 213599 - DNA, 25 bp, E. coli
gattttaataccacgacagtcggca

SEQ ID NO: 213600 - DNA, 25 bp, E. coli
gattttaatacctcgacagtcggca

SEQ ID NO: 213601 - DNA, 25 bp, E. coli
ggttctccgatcgaaaaggtgcaag

SEQ ID NO: 213602 - DNA, 25 bp, E. coli
ggttctccgatccaaaaggtgcaag

SEQ ID NO: 213603 - DNA, 25 bp, E. coli
tggcaaaggctatcgcaccggttta

SEQ ID NO: 213604 - DNA, 25 bp, E. coli
ggcgcaaactgtggctcaacgtgat

SEQ ID NO: 213605 - DNA, 25 bp, E. coli
tggcaaaggctaacgcaccggttta

SEQ ID NO: 213606 - DNA, 25 bp, E. coli
ggcgcaaactgtcgctcaacgtgat

SEQ ID NO: 213607 - DNA, 25 bp, E. coli
aagcagatttgccttatagcgcaca

SEQ ID NO: 213608 - DNA, 25 bp, E. coli
aagcagatttgcgttatagcgcaca

SEQ ID NO: 213609 - DNA, 25 bp, E. coli
cattatcacgggaaagaacgtgccg

SEQ ID NO: 213610 - DNA, 25 bp, E. coli
tagcgcacattatcacgggaaagaa

SEQ ID NO: 213611 - DNA, 25 bp, E. coli
tagcgcacattaacacgggaaagaa

SEQ ID NO: 213612 - DNA, 25 bp, E. coli
ttgctacggattttggctgaatcgg

SEQ ID NO: 213613 - DNA, 25 bp, E. coli
ttgctacggattatggctgaatcgg

SEQ ID NO: 213614 - DNA, 25 bp, E. coli
gccttatagcgctcattatcacggg

SEQ ID NO: 213615 - DNA, 25 bp, E. coli
gccttatagcgcacattatcacggg

SEQ ID NO: 213616 - DNA, 25 bp, E. coli
gcattgctgaagtaaaaagacaaaa

SEQ ID NO: 213617 - DNA, 25 bp, E. coli
gcattgctgaagaaaaaagacaaaa

SEQ ID NO: 213618 - DNA, 25 bp, E. coli
gctgaatcggtgtagcagatttgcc

SEQ ID NO: 213619 - DNA, 25 bp, E. coli
gctgaatcggtgaagcagatttgcc

SEQ ID NO: 213620 - DNA, 25 bp, E. coli
gaacgtgccgaattatcttaaacag

SEQ ID NO: 213621 - DNA, 25 bp, E. coli
gaacgtgccgaaatatcttaaacag

SEQ ID NO: 213622 - DNA, 25 bp, E. coli
ccgaaatatctttaacaggcgaaat

SEQ ID NO: 213623 - DNA, 25 bp, E. coli
ccgaaatatcttaaacaggcgaaat

SEQ ID NO: 213624 - DNA, 25 bp, E. coli
cgggaaagaacgagccgaaatatct

SEQ ID NO: 213625 - DNA, 25 bp, E. coli
cattatcacgggtaagaacgtgccg

SEQ ID NO: 213626 - DNA, 25 bp, E. coli
cgggaaagaacgtgccgaaatatct

SEQ ID NO: 213627 - DNA, 25 bp, E. coli
ggcgaaatttaaggcattgctgaag

SEQ ID NO: 213628 - DNA, 25 bp, E. coli
ggcgaaatttaacgcattgctgaag

SEQ ID NO: 213629 - DNA, 25 bp, E. coli
aaagagctgggcaatgcgctgcagc

SEQ ID NO: 213630 - DNA, 25 bp, E. coli
aaagagctgggctatgcgctgcagc

SEQ ID NO: 213631 - DNA, 25 bp, E. coli
tattcccggcgcctttattcagcaa

SEQ ID NO: 213632 - DNA, 25 bp, E. coli
tattcccggcgcgtttattcagcaa

SEQ ID NO: 213633 - DNA, 25 bp, E. coli
ttattcagcaactgaaaaatggccg

SEQ ID NO: 213634 - DNA, 25 bp, E. coli
ttattcagcaacagaaaaatggccg

SEQ ID NO: 213635 - DNA, 25 bp, E. coli
tgggctatgcgcagcagcatcaact

SEQ ID NO: 213636 - DNA, 25 bp, E. coli
tgggctatgcgctgcagcatcaact

SEQ ID NO: 213637 - DNA, 25 bp, E. coli
tgccgctgaccagggcgtttaaaca

SEQ ID NO: 213638 - DNA, 25 bp, E. coli
tccgaaagagctgggctatgcgctg

SEQ ID NO: 213639 - DNA, 25 bp, E. coli
tgccgctgaccacggcgtttaaaca

SEQ ID NO: 213640 - DNA, 25 bp, E. coli
tccgaaagagctcggctatgcgctg

SEQ ID NO: 213641 - DNA, 25 bp, E. coli
tcttccgaaagagctgggctatgcg

SEQ ID NO: 213642 - DNA, 25 bp, E. coli
tcttccgaaagacctgggctatgcg

SEQ ID NO: 213643 - DNA, 25 bp, E. coli
gcggtgccgctgaccacggcgttta

SEQ ID NO: 213644 - DNA, 25 bp, E. coli
gcggtgccgctgtccacggcgttta

SEQ ID NO: 213645 - DNA, 25 bp, E. coli
cgtcttccgaaacagctgggctatg

SEQ ID NO: 213646 - DNA, 25 bp, E. coli
cgtcttccgaaagagctgggctatg

SEQ ID NO: 213647 - DNA, 25 bp, E. coli
ggtgccgctgaccacggcgtttaaa

SEQ ID NO: 213648 - DNA, 25 bp, E. coli
ggtgccgctgacgacggcgtttaaa

SEQ ID NO: 213649 - DNA, 25 bp, E. coli
gagctgggctatgcgctgcagcatc

SEQ ID NO: 213650 - DNA, 25 bp, E. coli
gagctgggctatccgctgcagcatc

SEQ ID NO: 213651 - DNA, 25 bp, E. coli
taaaatacgcagtattttcctggga

SEQ ID NO: 213652 - DNA, 25 bp, E. coli
taaaatacgcagaattttcctggga

SEQ ID NO: 213653 - DNA, 25 bp, E. coli
actttcacagcacaaagatagatga

SEQ ID NO: 213654 - DNA, 25 bp, E. coli
actttcacagcagaaagatagatga

SEQ ID NO: 213655 - DNA, 25 bp, E. coli
tagatgaaatcgagctttttgctgt

SEQ ID NO: 213656 - DNA, 25 bp, E. coli
tagatgaaatcgtgctttttgctgt

SEQ ID NO: 213657 - DNA, 25 bp, E. coli
tccattgcgcaattacccggtaaaa

SEQ ID NO: 213658 - DNA, 25 bp, E. coli
tccattgcgcaaatacccggtaaaa

SEQ ID NO: 213659 - DNA, 25 bp, E. coli
cctgggattggtgaaaaggagctca

SEQ ID NO: 213660 - DNA, 25 bp, E. coli
gccgattacctctagtgcaagtgca

SEQ ID NO: 213661 - DNA, 25 bp, E. coli
cctgggattggtcaaaaggagctca

SEQ ID NO: 213662 - DNA, 25 bp, E. coli
gccgattacctcaagtgcaagtgca

SEQ ID NO: 213663 - DNA, 25 bp, E. coli
gctgttttttcgaacatatcctaac

SEQ ID NO: 213664 - DNA, 25 bp, E. coli
gctgttttttcgtacatatcctaac

SEQ ID NO: 213665 - DNA, 25 bp, E. coli
gcaagtgcactattaactttcacag

SEQ ID NO: 213666 - DNA, 25 bp, E. coli
gcaagtgcactaataactttcacag

SEQ ID NO: 213667 - DNA, 25 bp, E. coli
gaacatatcctaactgtccattgcg

SEQ ID NO: 213668 - DNA, 25 bp, E. coli
gaacatatcctatctgtccattgcg

SEQ ID NO: 213669 - DNA, 25 bp, E. coli
tggtcaaaaggagctcatcctgatt

SEQ ID NO: 213670 - DNA, 25 bp, E. coli
tggtcaaaaggacctcatcctgatt

SEQ ID NO: 213671 - DNA, 25 bp, E. coli
tcactaagagtaattgccgattacc

SEQ ID NO: 213672 - DNA, 25 bp, E. coli
tcactaagagtatttgccgattacc

SEQ ID NO: 213673 - DNA, 25 bp, E. coli
tacaaagtacaatgaataacaccgg

SEQ ID NO: 213674 - DNA, 25 bp, E. coli
tacgtcgtgtacagtctaccgaacg

SEQ ID NO: 213675 - DNA, 25 bp, E. coli
tacaaagtacaaagaataacaccgg

SEQ ID NO: 213676 - DNA, 25 bp, E. coli
tagggctatagcaacaagagcttcc

SEQ ID NO: 213677 - DNA, 25 bp, E. coli
tagggctatagctacaagagcttcc

SEQ ID NO: 213678 - DNA, 25 bp, E. coli
taccgaacgtctagataatagggct

SEQ ID NO: 213679 - DNA, 25 bp, E. coli
tacgtcgtgtactgtctaccgaacg

SEQ ID NO: 213680 - DNA, 25 bp, E. coli
taccgaacgtcttgataatagggct

SEQ ID NO: 213681 - DNA, 25 bp, E. coli
ttctggcggtgtcactaaggctttg

SEQ ID NO: 213682 - DNA, 25 bp, E. coli
ttctggcggtgtgactaaggctttg

SEQ ID NO: 213683 - DNA, 25 bp, E. coli
tgaacatgcgtcttggaacaggttc

SEQ ID NO: 213684 - DNA, 25 bp, E. coli
tgaacatgcgtcatggaacaggttc

SEQ ID NO: 213685 - DNA, 25 bp, E. coli
tcaggagcggtattcaagacatttc

SEQ ID NO: 213686 - DNA, 25 bp, E. coli
tcaggagcggtaatcaagacatttc

SEQ ID NO: 213687 - DNA, 25 bp, E. coli
gacatttctgacaagtgaacatgcg

SEQ ID NO: 213688 - DNA, 25 bp, E. coli
gacatttctgactagtgaacatgcg

SEQ ID NO: 213689 - DNA, 25 bp, E. coli
ggatgtttctcatcgctatttagcg

SEQ ID NO: 213690 - DNA, 25 bp, E. coli
ggatgtttctcaacgctatttagcg

SEQ ID NO: 213691 - DNA, 25 bp, E. coli
tggtttcctcgttctcccctggagg

SEQ ID NO: 213692 - DNA, 25 bp, E. coli
tggtttcctcgtactcccctggagg

SEQ ID NO: 213693 - DNA, 25 bp, E. coli
taacaccggaaaatggatgtttctc

SEQ ID NO: 213694 - DNA, 25 bp, E. coli
taacaccggaaattggatgtttctc

SEQ ID NO: 213695 - DNA, 25 bp, E. coli
cagctccgggttgggacacttgaga

SEQ ID NO: 213696 - DNA, 25 bp, E. coli
cagctccgggttcggacacttgaga

SEQ ID NO: 213697 - DNA, 25 bp, E. coli
catgttttgcatccatgggtggcgt

SEQ ID NO: 213698 - DNA, 25 bp, E. coli
catgttttgcatgcatgggtggcgt

SEQ ID NO: 213699 - DNA, 25 bp, E. coli
taaacgcgagctgatgcaaggttcg

SEQ ID NO: 213700 - DNA, 25 bp, E. coli
taaacgcgagctcatgcaaggttcg

SEQ ID NO: 213701 - DNA, 25 bp, E. coli
tttgctgattgggaagccactgggt

SEQ ID NO: 213702 - DNA, 25 bp, E. coli
tttgctgattggcaagccactgggt

SEQ ID NO: 213703 - DNA, 25 bp, E. coli
tgttattgccgcaatcggcgggatg

SEQ ID NO: 213704 - DNA, 25 bp, E. coli
tgttattgccgctatcggcgggatg

SEQ ID NO: 213705 - DNA, 25 bp, E. coli
tgcaaggttcgcaggccagtctgcg

SEQ ID NO: 213706 - DNA, 25 bp, E. coli
tgcaaggttcgctggccagtctgcg

SEQ ID NO: 213707 - DNA, 25 bp, E. coli
gctgctatggatgaatgacgctctg

SEQ ID NO: 213708 - DNA, 25 bp, E. coli
gctgctatggatcaatgacgctctg

SEQ ID NO: 213709 - DNA, 25 bp, E. coli
gaaattggcacatctgccagaggga

SEQ ID NO: 213710 - DNA, 25 bp, E. coli
gaaattggcacaactgccagaggga

SEQ ID NO: 213711 - DNA, 25 bp, E. coli
gatcaacaagaagatgctgctatgg

SEQ ID NO: 213712 - DNA, 25 bp, E. coli
gatcaacaagaacatgctgctatgg

SEQ ID NO: 213713 - DNA, 25 bp, E. coli
ggtttgacctccttcctgccattag

SEQ ID NO: 213714 - DNA, 25 bp, E. coli
ggtttgacctccatcctgccattag

SEQ ID NO: 213715 - DNA, 25 bp, E. coli
ggcgctctccgggtaaacgtctgga

SEQ ID NO: 213716 - DNA, 25 bp, E. coli
ggcgctctccggctaaacgtctgga

SEQ ID NO: 213717 - DNA, 25 bp, E. coli
aagtgatgtcctacagtgacgcagg

SEQ ID NO: 213718 - DNA, 25 bp, E. coli
aagtgatgtccttcagtgacgcagg

SEQ ID NO: 213719 - DNA, 25 bp, E. coli
cacgctggatgtgaagaccattgcc

SEQ ID NO: 213720 - DNA, 25 bp, E. coli
cacgctggatgtcaagaccattgcc

SEQ ID NO: 213721 - DNA, 25 bp, E. coli
cattattgaagctgcggcgaacggt

SEQ ID NO: 213722 - DNA, 25 bp, E. coli
cattattgaagcagcggcgaacggt

SEQ ID NO: 213723 - DNA, 25 bp, E. coli
tattcctggcggtatcctgtttgca

SEQ ID NO: 213724 - DNA, 25 bp, E. coli
tattcctggcggaatcctgtttgca

SEQ ID NO: 213725 - DNA, 25 bp, E. coli
ttagtccggcgacggaaccttcgca

SEQ ID NO: 213726 - DNA, 25 bp, E. coli
ttagtccggcgagggaaccttcgca

SEQ ID NO: 213727 - DNA, 25 bp, E. coli
gctggtcggtcccaaaatggatgtt

SEQ ID NO: 213728 - DNA, 25 bp, E. coli
gctggtcggtccgaaaatggatgtt

SEQ ID NO: 213729 - DNA, 25 bp, E. coli
gaatcgcaacgagctatttacggct

SEQ ID NO: 213730 - DNA, 25 bp, E. coli
gaatcgcaacgacctatttacggct

SEQ ID NO: 213731 - DNA, 25 bp, E. coli
gactatttgttacccgcttcgctga

SEQ ID NO: 213732 - DNA, 25 bp, E. coli
gactatttgttagccgcttcgctga

SEQ ID NO: 213733 - DNA, 25 bp, E. coli
cgaacggtgcaatgactgggctgaa

SEQ ID NO: 213734 - DNA, 25 bp, E. coli
cgaacggtgcaaagactgggctgaa

SEQ ID NO: 213735 - DNA, 25 bp, E. coli
cattatctcgttggccctctgtggg

SEQ ID NO: 213736 - DNA, 25 bp, E. coli
cattttcggctaagtgctggccccg

SEQ ID NO: 213737 - DNA, 25 bp, E. coli
cattttcggctatgtgctggccccg

SEQ ID NO: 213738 - DNA, 25 bp, E. coli
cattatctcgttcgccctctgtggg

SEQ ID NO: 213739 - DNA, 25 bp, E. coli
caatcaaatgctatttctgaccggt

SEQ ID NO: 213740 - DNA, 25 bp, E. coli
caatcaaatgctttttctgaccggt

SEQ ID NO: 213741 - DNA, 25 bp, E. coli
caaatgctttttgtgaccggtgaat

SEQ ID NO: 213742 - DNA, 25 bp, E. coli
caaatgctttttctgaccggtgaat

SEQ ID NO: 213743 - DNA, 25 bp, E. coli
tattgatgccgaagattcgccacgc

SEQ ID NO: 213744 - DNA, 25 bp, E. coli
tattgatgccgatgattcgccacgc

SEQ ID NO: 213745 - DNA, 25 bp, E. coli
tttttctgaccggtgaattgcgtca

SEQ ID NO: 213746 - DNA, 25 bp, E. coli
tttttctgaccgctgaattgcgtca

SEQ ID NO: 213747 - DNA, 25 bp, E. coli
tgactatattgaagccgatgattcg

SEQ ID NO: 213748 - DNA, 25 bp, E. coli
tgactatattgatgccgatgattcg

SEQ ID NO: 213749 - DNA, 25 bp, E. coli
tgctttttctgaccggtgaattgcg

SEQ ID NO: 213750 - DNA, 25 bp, E. coli
tgctttttctgagcggtgaattgcg

SEQ ID NO: 213751 - DNA, 25 bp, E. coli
tcgccatagcgcgaatcaaatgctt

SEQ ID NO: 213752 - DNA, 25 bp, E. coli
tcgccatagcgccaatcaaatgctt

SEQ ID NO: 213753 - DNA, 25 bp, E. coli
ccagggaaggctcgctcaccacaga

SEQ ID NO: 213754 - DNA, 25 bp, E. coli
ccagggaaggctggctcaccacaga

SEQ ID NO: 213755 - DNA, 25 bp, E. coli
cggtgaattgcgtcagataaaaggc

SEQ ID NO: 213756 - DNA, 25 bp, E. coli
cggtgaattgcgacagataaaaggc

SEQ ID NO: 213757 - DNA, 25 bp, E. coli
gaccggtgaattgcgtcagataaaa

SEQ ID NO: 213758 - DNA, 25 bp, E. coli
gatcagttttcagggccagcttcat

SEQ ID NO: 213759 - DNA, 25 bp, E. coli
gaccggtgaattccgtcagataaaa

SEQ ID NO: 213760 - DNA, 25 bp, E. coli
gatcagttttcacggccagcttcat

SEQ ID NO: 213761 - DNA, 25 bp, E. coli
caggtgttgatcaagaacccgccga

SEQ ID NO: 213762 - DNA, 25 bp, E. coli
caggtgttgatctagaacccgccga

SEQ ID NO: 213763 - DNA, 25 bp, E. coli
aggtgttgatcatgaacccgccgag

SEQ ID NO: 213764 - DNA, 25 bp, E. coli
aggtgttgatcaagaacccgccgag

SEQ ID NO: 213765 - DNA, 25 bp, E. coli
atccgcaggtgttgatcaagaaccc

SEQ ID NO: 213766 - DNA, 25 bp, E. coli
atccgcaggtgtagatcaagaaccc

SEQ ID NO: 213767 - DNA, 25 bp, E. coli
tgttgatcaagaacccgccgagcca

SEQ ID NO: 213768 - DNA, 25 bp, E. coli
tgttgatcaagatcccgccgagcca

SEQ ID NO: 213769 - DNA, 25 bp, E. coli
tccgcaggtgttcatcaagaacccg

SEQ ID NO: 213770 - DNA, 25 bp, E. coli
tccgcaggtgttgatcaagaacccg

SEQ ID NO: 213771 - DNA, 25 bp, E. coli
gcaggtgttgatcaagaacccgccg

SEQ ID NO: 213772 - DNA, 25 bp, E. coli
gcaggtgttgatgaagaacccgccg

SEQ ID NO: 213773 - DNA, 25 bp, E. coli
ccgcaggtgttgttcaagaacccgc

SEQ ID NO: 213774 - DNA, 25 bp, E. coli
ccgcaggtgttgatcaagaacccgc

SEQ ID NO: 213775 - DNA, 25 bp, E. coli
cgcaggtgttgaacaagaacccgcc

SEQ ID NO: 213776 - DNA, 25 bp, E. coli
cgcaggtgttgatcaagaacccgcc

SEQ ID NO: 213777 - DNA, 25 bp, E. coli
gttgatcaagaagccgccgagccag

SEQ ID NO: 213778 - DNA, 25 bp, E. coli
gttgatcaagaacccgccgagccag

SEQ ID NO: 213779 - DNA, 25 bp, E. coli
ggtgttgatcaagaacccgccgagc

SEQ ID NO: 213780 - DNA, 25 bp, E. coli
gtgttgatcaagtacccgccgagcc

SEQ ID NO: 213781 - DNA, 25 bp, E. coli
ggtgttgatcaacaacccgccgagc

SEQ ID NO: 213782 - DNA, 25 bp, E. coli
gtgttgatcaagaacccgccgagcc

SEQ ID NO: 213783 - DNA, 25 bp, E. coli
aatcgtacgccactaccgcgcggtg

SEQ ID NO: 213784 - DNA, 25 bp, E. coli
aatcatccgccgcatcgcactggcg

SEQ ID NO: 213785 - DNA, 25 bp, E. coli
aatcgtacgccagtaccgcgcggtg

SEQ ID NO: 213786 - DNA, 25 bp, E. coli
aatcatccgccggatcgcactggcg

SEQ ID NO: 213787 - DNA, 25 bp, E. coli
acggcaaaatcgaacgccagtaccg

SEQ ID NO: 213788 - DNA, 25 bp, E. coli
atcgatgaaatcatccgccgcatcg

SEQ ID NO: 213789 - DNA, 25 bp, E. coli
atcgtacgccagaaccgcgcggtgc

SEQ ID NO: 213790 - DNA, 25 bp, E. coli
atcgatgaaatcttccgccgcatcg

SEQ ID NO: 213791 - DNA, 25 bp, E. coli
acggcaaaatcgtacgccagtaccg

SEQ ID NO: 213792 - DNA, 25 bp, E. coli
atcgtacgccagtaccgcgcggtgc

SEQ ID NO: 213793 - DNA, 25 bp, E. coli
aaatcgtacgccagtaccgcgcggt

SEQ ID NO: 213794 - DNA, 25 bp, E. coli
aaaatcgtacgccagtaccgcgcgg

SEQ ID NO: 213795 - DNA, 25 bp, E. coli
aaaatcgtacgcgagtaccgcgcgg

SEQ ID NO: 213796 - DNA, 25 bp, E. coli
aaatcgtacgcctgtaccgcgcggt

SEQ ID NO: 213797 - DNA, 25 bp, E. coli
tcgatgaaatcaaccgccgcatcgc

SEQ ID NO: 213798 - DNA, 25 bp, E. coli
tcgatgaaatcatccgccgcatcgc

SEQ ID NO: 213799 - DNA, 25 bp, E. coli
cgatgaaatcatgcgccgcatcgca

SEQ ID NO: 213800 - DNA, 25 bp, E. coli
cgatgaaatcatccgccgcatcgca

SEQ ID NO: 213801 - DNA, 25 bp, E. coli
ggcaaaatcgtacgccagtaccgcg

SEQ ID NO: 213802 - DNA, 25 bp, E. coli
ggcaaaatcgtaggccagtaccgcg

SEQ ID NO: 213803 - DNA, 25 bp, E. coli
taacggcaaaatcgtacgccagtac

SEQ ID NO: 213804 - DNA, 25 bp, E. coli
taacggcaaaatggtacgccagtac

SEQ ID NO: 213805 - DNA, 25 bp, E. coli
catagaacacctgttaaaaaccgcg

SEQ ID NO: 213806 - DNA, 25 bp, E. coli
catattgccgcacagtcagggagat

SEQ ID NO: 213807 - DNA, 25 bp, E. coli
catattgccgcagagtcagggagat

SEQ ID NO: 213808 - DNA, 25 bp, E. coli
catagaacacctcttaaaaaccgcg

SEQ ID NO: 213809 - DNA, 25 bp, E. coli
agatactaaagacgccatattgccg

SEQ ID NO: 213810 - DNA, 25 bp, E. coli
agatactaaagaggccatattgccg

SEQ ID NO: 213811 - DNA, 25 bp, E. coli
aaagggcgttcaccaggagatacta

SEQ ID NO: 213812 - DNA, 25 bp, E. coli
aaagggcgttcagcaggagatacta

SEQ ID NO: 213813 - DNA, 25 bp, E. coli
ttatgctggataaaaagggcgttca

SEQ ID NO: 213814 - DNA, 25 bp, E. coli
ttatgctggatataaagggcgttca

SEQ ID NO: 213815 - DNA, 25 bp, E. coli
tgtatctaccgttatcggagtggct

SEQ ID NO: 213816 - DNA, 25 bp, E. coli
tgtatctaccgtaatcggagtggct

SEQ ID NO: 213817 - DNA, 25 bp, E. coli
tcagggagatgtcagccagctcacc

SEQ ID NO: 213818 - DNA, 25 bp, E. coli
tcagggagatgtgagccagctcacc

SEQ ID NO: 213819 - DNA, 25 bp, E. coli
gctcaccataaaaaagccgcatgtt

SEQ ID NO: 213820 - DNA, 25 bp, E. coli
gctcaccataaataagccgcatgtt

SEQ ID NO: 213821 - DNA, 25 bp, E. coli
gcacctcattgttgtcggcgctctc

SEQ ID NO: 213822 - DNA, 25 bp, E. coli
gcacctcattgtagtcggcgctctc

SEQ ID NO: 213823 - DNA, 25 bp, E. coli
gtggagcacctcatttcaagcatag

SEQ ID NO: 213824 - DNA, 25 bp, E. coli
gtggagcacctcttttcaagcatag

SEQ ID NO: 213825 - DNA, 25 bp, E. coli
gagtgccactaaaccgcttctgaac

SEQ ID NO: 213826 - DNA, 25 bp, E. coli
gagtgccactaatccgcttctgaac

SEQ ID NO: 213827 - DNA, 25 bp, E. coli
cataatggtgaaggcgggcaatgct

SEQ ID NO: 213828 - DNA, 25 bp, E. coli
cataatggtgaacgcgggcaatgct

SEQ ID NO: 213829 - DNA, 25 bp, E. coli
aaacatctgacgtttgatgcgccct

SEQ ID NO: 213830 - DNA, 25 bp, E. coli
aaactgtacgctcgcagaatccgcg

SEQ ID NO: 213831 - DNA, 25 bp, E. coli
aaacatctgacgattgatgcgccct

SEQ ID NO: 213832 - DNA, 25 bp, E. coli
aaactgtacgctggcagaatccgcg

SEQ ID NO: 213833 - DNA, 25 bp, E. coli
ttacttcgtgctgttacccgtcgcg

SEQ ID NO: 213834 - DNA, 25 bp, E. coli
tagctgctgccgtcagggttgcgct

SEQ ID NO: 213835 - DNA, 25 bp, E. coli
tagctgctgccgacagggttgcgct

SEQ ID NO: 213836 - DNA, 25 bp, E. coli
ttacttcgtgctcttacccgtcgcg

SEQ ID NO: 213837 - DNA, 25 bp, E. coli
tttcaggtatttagtggtgcgcagc

SEQ ID NO: 213838 - DNA, 25 bp, E. coli
tttcaggtattttgtggtgcgcagc

SEQ ID NO: 213839 - DNA, 25 bp, E. coli
tcatttacaccctgaaggcgacgct

SEQ ID NO: 213840 - DNA, 25 bp, E. coli
tcatttacacccagaaggcgacgct

SEQ ID NO: 213841 - DNA, 25 bp, E. coli
gcgggtcattgcctcaacatcatca

SEQ ID NO: 213842 - DNA, 25 bp, E. coli
gcgggtcattgcgtcaacatcatca

SEQ ID NO: 213843 - DNA, 25 bp, E. coli
cgcgatcacgcacgccataatggtg

SEQ ID NO: 213844 - DNA, 25 bp, E. coli
cgcgatcacgcaggccataatggtg

SEQ ID NO: 213845 - DNA, 25 bp, E. coli
cattgcagaatcttgtcgcgggtca

SEQ ID NO: 213846 - DNA, 25 bp, E. coli
cattgcagaatcatgtcgcgggtca

SEQ ID NO: 213847 - DNA, 25 bp, E. coli
gatattctgctgctgtgtccggcgc

SEQ ID NO: 213848 - DNA, 25 bp, E. coli
gatattctgctggtgtgtccggcgc

SEQ ID NO: 213849 - DNA, 25 bp, E. coli
cagaacgtgcaatcaaaacatcaaa

SEQ ID NO: 213850 - DNA, 25 bp, E. coli
cagaacgtgcaaacaaaacatcaaa

SEQ ID NO: 213851 - DNA, 25 bp, E. coli
atcagaacgatttctggcgctgtga

SEQ ID NO: 213852 - DNA, 25 bp, E. coli
atcagaacgattactggcgctgtga

SEQ ID NO: 213853 - DNA, 25 bp, E. coli
aaacatcaaaaaggcaatcagaacg

SEQ ID NO: 213854 - DNA, 25 bp, E. coli
aaacatcaaaaacgcaatcagaacg

SEQ ID NO: 213855 - DNA, 25 bp, E. coli
tcagaagggaaacggatcaacagaa

SEQ ID NO: 213856 - DNA, 25 bp, E. coli
tcagaagggaaagggatcaacagaa

SEQ ID NO: 213857 - DNA, 25 bp, E. coli
gcaaatgaatttaaaaacggcatgg

SEQ ID NO: 213858 - DNA, 25 bp, E. coli
gaatcccctacatacgaaaagatgg

SEQ ID NO: 213859 - DNA, 25 bp, E. coli
gaatcccctacaaacgaaaagatgg

SEQ ID NO: 213860 - DNA, 25 bp, E. coli
gcaaatgaattttaaaacggcatgg

SEQ ID NO: 213861 - DNA, 25 bp, E. coli
gcaatcagaacgttttctggcgctg

SEQ ID NO: 213862 - DNA, 25 bp, E. coli
gcaatcagaacgatttctggcgctg

SEQ ID NO: 213863 - DNA, 25 bp, E. coli
gaaaagtcagaagggaaacggatca

SEQ ID NO: 213864 - DNA, 25 bp, E. coli
gaaaaaacacaagaccagcaaatga

SEQ ID NO: 213865 - DNA, 25 bp, E. coli
gaaaagtcagaacggaaacggatca

SEQ ID NO: 213866 - DNA, 25 bp, E. coli
gaaaaaacacaacaccagcaaatga

SEQ ID NO: 213867 - DNA, 25 bp, E. coli
ggatcaacagaacgtgcaaacaaaa

SEQ ID NO: 213868 - DNA, 25 bp, E. coli
ggatcaacagaaggtgcaaacaaaa

SEQ ID NO: 213869 - DNA, 25 bp, E. coli
gatgggaaaaaacacaacaccagca

SEQ ID NO: 213870 - DNA, 25 bp, E. coli
gatgggaaaaaagacaacaccagca

SEQ ID NO: 213871 - DNA, 25 bp, E. coli
caaaagcggttaacaccggcgacgt

SEQ ID NO: 213872 - DNA, 25 bp, E. coli
caaaagcggttatcaccggcgacgt

SEQ ID NO: 213873 - DNA, 25 bp, E. coli
catgacattaccttcggcgttggcc

SEQ ID NO: 213874 - DNA, 25 bp, E. coli
catgacattaccatcggcgttggcc

SEQ ID NO: 213875 - DNA, 25 bp, E. coli
taaaacctacctggcagtggctgcg

SEQ ID NO: 213876 - DNA, 25 bp, E. coli
tacgacgcgctgtttgaaatgctgg

SEQ ID NO: 213877 - DNA, 25 bp, E. coli
taaaacctacctcgcagtggctgcg

SEQ ID NO: 213878 - DNA, 25 bp, E. coli
aacggtttgaacttagacactcgcg

SEQ ID NO: 213879 - DNA, 25 bp, E. coli
aacggtttgaacatagacactcgcg

SEQ ID NO: 213880 - DNA, 25 bp, E. coli
acgttattgaagtcgcaccgctggc

SEQ ID NO: 213881 - DNA, 25 bp, E. coli
acgttattgaagacgcaccgctggc

SEQ ID NO: 213882 - DNA, 25 bp, E. coli
tacgacgcgctgattgaaatgctgg

SEQ ID NO: 213883 - DNA, 25 bp, E. coli
tgtatgtcgatagtgccccgatgcg

SEQ ID NO: 213884 - DNA, 25 bp, E. coli
tgtatgtcgatactgccccgatgcg

SEQ ID NO: 213885 - DNA, 25 bp, E. coli
tgaagatgttcctgacccgtatcgg

SEQ ID NO: 213886 - DNA, 25 bp, E. coli
tgaagatgttccagacccgtatcgg

SEQ ID NO: 213887 - DNA, 25 bp, E. coli
cctatgaagcctcggaagaagccga

SEQ ID NO: 213888 - DNA, 25 bp, E. coli
cctatgaagcctgggaagaagccga

SEQ ID NO: 213889 - DNA, 25 bp, E. coli
gaaactgggcttcctgcctggcgat

SEQ ID NO: 213890 - DNA, 25 bp, E. coli
gaaactgggcttgctgcctggcgat

SEQ ID NO: 213891 - DNA, 25 bp, E. coli
gatttaagccagtaagtagacccgt

SEQ ID NO: 213892 - DNA, 25 bp, E. coli
gatttaagccagaaagtagacccgt

SEQ ID NO: 213893 - DNA, 25 bp, E. coli
caagaaagcctgaacctggcgctac

SEQ ID NO: 213894 - DNA, 25 bp, E. coli
caagaaagcctgtacctggcgctac

SEQ ID NO: 213895 - DNA, 25 bp, E. coli
caaagatggtttgcacggcgatacc

SEQ ID NO: 213896 - DNA, 25 bp, E. coli
caaagatggtttccacggcgatacc

SEQ ID NO: 213897 - DNA, 25 bp, E. coli
tatgactcccgtcaaaccaacgtcg

SEQ ID NO: 213898 - DNA, 25 bp, E. coli
tatgactcccgtgaaaccaacgtcg

SEQ ID NO: 213899 - DNA, 25 bp, E. coli
tattgtggtgacagataacggctgc

SEQ ID NO: 213900 - DNA, 25 bp, E. coli
tatcgaaaaaatccgcgtcgctggc

SEQ ID NO: 213901 - DNA, 25 bp, E. coli
tattgtggtgactgataacggctgc

SEQ ID NO: 213902 - DNA, 25 bp, E. coli
tatcgaaaaaatgcgcgtcgctggc

SEQ ID NO: 213903 - DNA, 25 bp, E. coli
ttaatctgcgcgaaatcggtgcggc

SEQ ID NO: 213904 - DNA, 25 bp, E. coli
ttaatctgcgcgtaatcggtgcggc

SEQ ID NO: 213905 - DNA, 25 bp, E. coli
tcgagccaatggacaacgcgggtaa

SEQ ID NO: 213906 - DNA, 25 bp, E. coli
tcgagccaatggtcaacgcgggtaa

SEQ ID NO: 213907 - DNA, 25 bp, E. coli
tcggtaagccgagcatcatgggcga

SEQ ID NO: 213908 - DNA, 25 bp, E. coli
tcggtaagccgaccatcatgggcga

SEQ ID NO: 213909 - DNA, 25 bp, E. coli
gaaattctgacggtacgcaaggatg

SEQ ID NO: 213910 - DNA, 25 bp, E. coli
gacacggtattggtcgcggcttcca

SEQ ID NO: 213911 - DNA, 25 bp, E. coli
gacacggtattgctcgcggcttcca

SEQ ID NO: 213912 - DNA, 25 bp, E. coli
gaaattctgacgctacgcaaggatg

SEQ ID NO: 213913 - DNA, 25 bp, E. coli
tcagaaatttgtcgaagcagaaggc

SEQ ID NO: 213914 - DNA, 25 bp, E. coli
tcagaaatttgtggaagcagaaggc

SEQ ID NO: 213915 - DNA, 25 bp, E. coli
aattatccgtttccttggcgctacc

SEQ ID NO: 213916 - DNA, 25 bp, E. coli
aagcctgatgcgctatatctcggca

SEQ ID NO: 213917 - DNA, 25 bp, E. coli
aagcctgatgcggtatatctcggca

SEQ ID NO: 213918 - DNA, 25 bp, E. coli
aattatccgtttgcttggcgctacc

SEQ ID NO: 213919 - DNA, 25 bp, E. coli
catctacgaaggtttagtgctggct

SEQ ID NO: 213920 - DNA, 25 bp, E. coli
catctacgaaggattagtgctggct

SEQ ID NO: 213921 - DNA, 25 bp, E. coli
tgcagaattcctaaacaacccggta

SEQ ID NO: 213922 - DNA, 25 bp, E. coli
tgcagaattccttaacaacccggta

SEQ ID NO: 213923 - DNA, 25 bp, E. coli
gcgtacatgagtaacggaaaaccgg

SEQ ID NO: 213924 - DNA, 25 bp, E. coli
gcgtacatgagttacggaaaaccgg

SEQ ID NO: 213925 - DNA, 25 bp, E. coli
gaatgccatgcgctgtatgaccccg

SEQ ID NO: 213926 - DNA, 25 bp, E. coli
gaatgccatgcggtgtatgaccccg

SEQ ID NO: 213927 - DNA, 25 bp, E. coli
gaaataaagctcttcgataacccgg

SEQ ID NO: 213928 - DNA, 25 bp, E. coli
gaaataaagctcatcgataacccgg

SEQ ID NO: 213929 - DNA, 25 bp, E. coli
cgataacccggtcaaacttgcagaa

SEQ ID NO: 213930 - DNA, 25 bp, E. coli
cgataacccggtgaaacttgcagaa

SEQ ID NO: 213931 - DNA, 25 bp, E. coli
gattattctgcaaatggcttctcga

SEQ ID NO: 213932 - DNA, 25 bp, E. coli
gattattctgcatatggcttctcga

SEQ ID NO: 213933 - DNA, 25 bp, E. coli
gattccgtggcgtatatgcactaca

SEQ ID NO: 213934 - DNA, 25 bp, E. coli
gattccgtggcgaatatgcactaca

SEQ ID NO: 213935 - DNA, 25 bp, E. coli
ggttcctgacacgaccaaatacgga

SEQ ID NO: 213936 - DNA, 25 bp, E. coli
ggttcctgacaccaccaaatacgga

SEQ ID NO: 213937 - DNA, 25 bp, E. coli
catggtgaacgtttctctgtgcgtc

SEQ ID NO: 213938 - DNA, 25 bp, E. coli
catggtgaacgtatctctgtgcgtc

SEQ ID NO: 213939 - DNA, 25 bp, E. coli
taaactgatggatgaagacaccgac

SEQ ID NO: 213940 - DNA, 25 bp, E. coli
tactggttcgaaagcggcaatgcat

SEQ ID NO: 213941 - DNA, 25 bp, E. coli
tactggttcgaatgcggcaatgcat

SEQ ID NO: 213942 - DNA, 25 bp, E. coli
taaataaacctgtctgggcgcagtg

SEQ ID NO: 213943 - DNA, 25 bp, E. coli
taaataaacctgactgggcgcagtg

SEQ ID NO: 213944 - DNA, 25 bp, E. coli
taaactgatggaagaagacaccgac

SEQ ID NO: 213945 - DNA, 25 bp, E. coli
ttctggcaaagttaaaccctggacg

SEQ ID NO: 213946 - DNA, 25 bp, E. coli
ttctggcaaagtaaaaccctggacg

SEQ ID NO: 213947 - DNA, 25 bp, E. coli
tgagcgatgtacgtttctggcaaag

SEQ ID NO: 213948 - DNA, 25 bp, E. coli
tgagcgatgtacctttctggcaaag

SEQ ID NO: 213949 - DNA, 25 bp, E. coli
gcctgtcgccaggtcaatattaaaa

SEQ ID NO: 213950 - DNA, 25 bp, E. coli
gcctgtcgccagctcaatattaaaa

SEQ ID NO: 213951 - DNA, 25 bp, E. coli
ccctggacgaaaagagcgatgcgga

SEQ ID NO: 213952 - DNA, 25 bp, E. coli
ccctggacgaaatgagcgatgcgga

SEQ ID NO: 213953 - DNA, 25 bp, E. coli
gtttcgagtttgtacccgactgcat

SEQ ID NO: 213954 - DNA, 25 bp, E. coli
gtttcgagtttgaacccgactgcat

SEQ ID NO: 213955 - DNA, 25 bp, E. coli
tggcggaacacctgatgagcgatgt

SEQ ID NO: 213956 - DNA, 25 bp, E. coli
tggcggaacaccagatgagcgatgt

SEQ ID NO: 213957 - DNA, 25 bp, E. coli
tcaatgtcggaagtacgaacgtcgt

SEQ ID NO: 213958 - DNA, 25 bp, E. coli
tcaatgtcggaactacgaacgtcgt

SEQ ID NO: 213959 - DNA, 25 bp, E. coli
aattaacacaggcccacagccgatc

SEQ ID NO: 213960 - DNA, 25 bp, E. coli
aattaacacagggccacagccgatc

SEQ ID NO: 213961 - DNA, 25 bp, E. coli
cagccgatccccatgggcctttgat

SEQ ID NO: 213962 - DNA, 25 bp, E. coli
cagccgatccccttgggcctttgat

SEQ ID NO: 213963 - DNA, 25 bp, E. coli
actaattaacacaggcccacagccg

SEQ ID NO: 213964 - DNA, 25 bp, E. coli
accactaattaagacaggcccacag

SEQ ID NO: 213965 - DNA, 25 bp, E. coli
agccgatccccaagggcctttgata

SEQ ID NO: 213966 - DNA, 25 bp, E. coli
accactaattaacacaggcccacag

SEQ ID NO: 213967 - DNA, 25 bp, E. coli
attagaaggtttgcatgaacaagcc

SEQ ID NO: 213968 - DNA, 25 bp, E. coli
attagaaggtttccatgaacaagcc

SEQ ID NO: 213969 - DNA, 25 bp, E. coli
agccgatccccatgggcctttgata

SEQ ID NO: 213970 - DNA, 25 bp, E. coli
actaattaacactggcccacagccg

SEQ ID NO: 213971 - DNA, 25 bp, E. coli
ttagaaggtttgcatgaacaagcca

SEQ ID NO: 213972 - DNA, 25 bp, E. coli
ttagaaggtttggatgaacaagcca

SEQ ID NO: 213973 - DNA, 25 bp, E. coli
gcgaataaccactaattaacacagg

SEQ ID NO: 213974 - DNA, 25 bp, E. coli
gcgaataaccacaaattaacacagg

SEQ ID NO: 213975 - DNA, 25 bp, E. coli
gaataaccactatttaacacaggcc

SEQ ID NO: 213976 - DNA, 25 bp, E. coli
gaataaccactaattaacacaggcc

SEQ ID NO: 213977 - DNA, 25 bp, E. coli
cgaataaccacttattaacacaggc

SEQ ID NO: 213978 - DNA, 25 bp, E. coli
cgaataaccactaattaacacaggc

SEQ ID NO: 213979 - DNA, 25 bp, E. coli
taaccactaatttacacaggcccac

SEQ ID NO: 213980 - DNA, 25 bp, E. coli
taaccactaattaacacaggcccac

SEQ ID NO: 213981 - DNA, 25 bp, E. coli
cactggtacggcgtgatgtatctgg

SEQ ID NO: 213982 - DNA, 25 bp, E. coli
cactggtacggcctgatgtatctgg

SEQ ID NO: 213983 - DNA, 25 bp, E. coli
cattttctcaataggacccgtggcg

SEQ ID NO: 213984 - DNA, 25 bp, E. coli
cagtagctatctccattttccggag

SEQ ID NO: 213985 - DNA, 25 bp, E. coli
cagtagctatctgcattttccggag

SEQ ID NO: 213986 - DNA, 25 bp, E. coli
tacaatttcccggagtttatggccg

SEQ ID NO: 213987 - DNA, 25 bp, E. coli
tacaatttcccgcagtttatggccg

SEQ ID NO: 213988 - DNA, 25 bp, E. coli
tttgctgctgcaaaccaacccgcag

SEQ ID NO: 213989 - DNA, 25 bp, E. coli
tttgctgctgcataccaacccgcag

SEQ ID NO: 213990 - DNA, 25 bp, E. coli
gctggcaacacgacgggcgaatcgt

SEQ ID NO: 213991 - DNA, 25 bp, E. coli
gctggcaacacgtcgggcgaatcgt

SEQ ID NO: 213992 - DNA, 25 bp, E. coli
gaaaacttactcaatgcgggcttcc

SEQ ID NO: 213993 - DNA, 25 bp, E. coli
gaaaacttactctatgcgggcttcc

SEQ ID NO: 213994 - DNA, 25 bp, E. coli
cattttctcaattggacccgtggcg

SEQ ID NO: 213995 - DNA, 25 bp, E. coli
ggcaatccattttcgacacttacgg

SEQ ID NO: 213996 - DNA, 25 bp, E. coli
ggctcccgtacagaagatattttgc

SEQ ID NO: 213997 - DNA, 25 bp, E. coli
ggcaatccatttacgacacttacgg

SEQ ID NO: 213998 - DNA, 25 bp, E. coli
ggcaaattctttccatcccgatgat

SEQ ID NO: 213999 - DNA, 25 bp, E. coli
ggcaaattctttgcatcccgatgat

SEQ ID NO: 214000 - DNA, 25 bp, E. coli
ggctcccgtacacaagatattttgc

SEQ ID NO: 214001 - DNA, 25 bp, E. coli
gatggtctgggcttatcgtcgcagc

SEQ ID NO: 214002 - DNA, 25 bp, E. coli
gatggtctgggcatatcgtcgcagc

SEQ ID NO: 214003 - DNA, 25 bp, E. coli
tactgactattcgagcctgattggc

SEQ ID NO: 214004 - DNA, 25 bp, E. coli
tactgactattccagcctgattggc

SEQ ID NO: 214005 - DNA, 25 bp, E. coli
ttgcaaagtaactggaaactgtacc

SEQ ID NO: 214006 - DNA, 25 bp, E. coli
ttgcaaagtaacaggaaactgtacc

SEQ ID NO: 214007 - DNA, 25 bp, E. coli
ttttttgcaaagtaactggaaactg

SEQ ID NO: 214008 - DNA, 25 bp, E. coli
tatcaatactgactattccagcctg

SEQ ID NO: 214009 - DNA, 25 bp, E. coli
ttttttgcaaagaaactggaaactg

SEQ ID NO: 214010 - DNA, 25 bp, E. coli
tatcaatactgagtattccagcctg

SEQ ID NO: 214011 - DNA, 25 bp, E. coli
tccagcctgattggccaaaaattga

SEQ ID NO: 214012 - DNA, 25 bp, E. coli
tccagcctgattcgccaaaaattga

SEQ ID NO: 214013 - DNA, 25 bp, E. coli
cctgcttagtctgcttatcattatc

SEQ ID NO: 214014 - DNA, 25 bp, E. coli
cctgcttagtctccttatcattatc

SEQ ID NO: 214015 - DNA, 25 bp, E. coli
gcaaagtaactggaaactgtaccag

SEQ ID NO: 214016 - DNA, 25 bp, E. coli
gcaaagtaactgcaaactgtaccag

SEQ ID NO: 214017 - DNA, 25 bp, E. coli
gactattccagcctgattggccaaa

SEQ ID NO: 214018 - DNA, 25 bp, E. coli
gactattccagcgtgattggccaaa

SEQ ID NO: 214019 - DNA, 25 bp, E. coli
cgcctgcacctggttagtctgctta

SEQ ID NO: 214020 - DNA, 25 bp, E. coli
cgcctgcacctgcttagtctgctta

SEQ ID NO: 214021 - DNA, 25 bp, E. coli
gtctgcttatcattatcaatactga

SEQ ID NO: 214022 - DNA, 25 bp, E. coli
ggaaactgtaccagttcacccgcct

SEQ ID NO: 214023 - DNA, 25 bp, E. coli
ggaaactgtacctgttcacccgcct

SEQ ID NO: 214024 - DNA, 25 bp, E. coli
gtctgcttatcaatatcaatactga

SEQ ID NO: 214025 - DNA, 25 bp, E. coli
caaaaaattctgctcgctgacagcg

SEQ ID NO: 214026 - DNA, 25 bp, E. coli
caaaaaattctggtcgctgacagcg

SEQ ID NO: 214027 - DNA, 25 bp, E. coli
taaagctgctcgataccgttcattg

SEQ ID NO: 214028 - DNA, 25 bp, E. coli
taaagctgctcgttaccgttcattg

SEQ ID NO: 214029 - DNA, 25 bp, E. coli
tatgcgccgggatttaaacctgtct

SEQ ID NO: 214030 - DNA, 25 bp, E. coli
tatgcgccgggaattaaacctgtct

SEQ ID NO: 214031 - DNA, 25 bp, E. coli
tgttggcttaccgaatctggcaccg

SEQ ID NO: 214032 - DNA, 25 bp, E. coli
tgttggcttacccaatctggcaccg

SEQ ID NO: 214033 - DNA, 25 bp, E. coli
tgatgcacacgatggctcaagtcgc

SEQ ID NO: 214034 - DNA, 25 bp, E. coli
tgatgcacacgaaggctcaagtcgc

SEQ ID NO: 214035 - DNA, 25 bp, E. coli
tgcctatgcaatgtggatcagcccg

SEQ ID NO: 214036 - DNA, 25 bp, E. coli
tgcctatgcaatctggatcagcccg

SEQ ID NO: 214037 - DNA, 25 bp, E. coli
gaaacagtatggaatccgcctgacg

SEQ ID NO: 214038 - DNA, 25 bp, E. coli
gaaacagtatggtatccgcctgacg

SEQ ID NO: 214039 - DNA, 25 bp, E. coli
gatcctgctggagtttatgcgccgg

SEQ ID NO: 214040 - DNA, 25 bp, E. coli
gttctctggataagcataagcctgc

SEQ ID NO: 214041 - DNA, 25 bp, E. coli
gatatggtaaccagcacaccggaaa

SEQ ID NO: 214042 - DNA, 25 bp, E. coli
gttctctggatatgcataagcctgc

SEQ ID NO: 214043 - DNA, 25 bp, E. coli
gatatggtaacctgcacaccggaaa

SEQ ID NO: 214044 - DNA, 25 bp, E. coli
taatcaggcataacaccagatggtg

SEQ ID NO: 214045 - DNA, 25 bp, E. coli
taatcaggcatatcaccagatggtg

SEQ ID NO: 214046 - DNA, 25 bp, E. coli
gatcctgctggactttatgcgccgg

SEQ ID NO: 214047 - DNA, 25 bp, E. coli
atcgactggcgagagcctaagcggc

SEQ ID NO: 214048 - DNA, 25 bp, E. coli
agcctaagcggcagctgacctccct

SEQ ID NO: 214049 - DNA, 25 bp, E. coli
actggcgacagcctaagcggctgct

SEQ ID NO: 214050 - DNA, 25 bp, E. coli
agcctaagcggctgctgacctccct

SEQ ID NO: 214051 - DNA, 25 bp, E. coli
atcgactggcgacagcctaagcggc

SEQ ID NO: 214052 - DNA, 25 bp, E. coli
actggcgacagcgtaagcggctgct

SEQ ID NO: 214053 - DNA, 25 bp, E. coli
tcgactggcgactgcctaagcggct

SEQ ID NO: 214054 - DNA, 25 bp, E. coli
tcgactggcgacagcctaagcggct

SEQ ID NO: 214055 - DNA, 25 bp, E. coli
tgctgacctccctgaccatgctgta

SEQ ID NO: 214056 - DNA, 25 bp, E. coli
tgctgacctcccagaccatgctgta

SEQ ID NO: 214057 - DNA, 25 bp, E. coli
gcgacagcctaagcggctgctgacc

SEQ ID NO: 214058 - DNA, 25 bp, E. coli
gcgacagcctaaccggctgctgacc

SEQ ID NO: 214059 - DNA, 25 bp, E. coli
gctgacctccctcaccatgctgtaa

SEQ ID NO: 214060 - DNA, 25 bp, E. coli
gctgacctccctgaccatgctgtaa

SEQ ID NO: 214061 - DNA, 25 bp, E. coli
cgactggcgacaccctaagcggctg

SEQ ID NO: 214062 - DNA, 25 bp, E. coli
cgactggcgacagcctaagcggctg

SEQ ID NO: 214063 - DNA, 25 bp, E. coli
ctggcgacagccaaagcggctgctg

SEQ ID NO: 214064 - DNA, 25 bp, E. coli
ctggcgacagcctaagcggctgctg

SEQ ID NO: 214065 - DNA, 25 bp, E. coli
ggcgacagcctatgcggctgctgac

SEQ ID NO: 214066 - DNA, 25 bp, E. coli
tggcgacagccttagcggctgctga

SEQ ID NO: 214067 - DNA, 25 bp, E. coli
tggcgacagcctaagcggctgctga

SEQ ID NO: 214068 - DNA, 25 bp, E. coli
ggcgacagcctaagcggctgctgac

SEQ ID NO: 214069 - DNA, 25 bp, E. coli
aattgtttcaggtgatgcacgggcg

SEQ ID NO: 214070 - DNA, 25 bp, E. coli
aattgtttcaggagatgcacgggcg

SEQ ID NO: 214071 - DNA, 25 bp, E. coli
tataccgaaaaagataagctgccgc

SEQ ID NO: 214072 - DNA, 25 bp, E. coli
tataccgaaaaacataagctgccgc

SEQ ID NO: 214073 - DNA, 25 bp, E. coli
tgagcgtttcgtccatcagtcagac

SEQ ID NO: 214074 - DNA, 25 bp, E. coli
tgagcgtttcgtgcatcagtcagac

SEQ ID NO: 214075 - DNA, 25 bp, E. coli
gaatttactaccagggctgccgtcg

SEQ ID NO: 214076 - DNA, 25 bp, E. coli
gaatttactacctgggctgccgtcg

SEQ ID NO: 214077 - DNA, 25 bp, E. coli
gaagtgcaggatgttcatgagcaac

SEQ ID NO: 214078 - DNA, 25 bp, E. coli
gaatttggctctattaccgccgccg

SEQ ID NO: 214079 - DNA, 25 bp, E. coli
gcacaaaatgttgtcgccgggctga

SEQ ID NO: 214080 - DNA, 25 bp, E. coli
gaatttggctcttttaccgccgccg

SEQ ID NO: 214081 - DNA, 25 bp, E. coli
gaagtgcaggatcttcatgagcaac

SEQ ID NO: 214082 - DNA, 25 bp, E. coli
gcacaaaatgttctcgccgggctga

SEQ ID NO: 214083 - DNA, 25 bp, E. coli
cggaagggatctcgactcgcctgat

SEQ ID NO: 214084 - DNA, 25 bp, E. coli
cggaagggatctggactcgcctgat

SEQ ID NO: 214085 - DNA, 25 bp, E. coli
cattggctgttcatcaactatggca

SEQ ID NO: 214086 - DNA, 25 bp, E. coli
cattggctgttcttcaactatggca

SEQ ID NO: 214087 - DNA, 25 bp, E. coli
tggaacgactaaaacgcatgtcggt

SEQ ID NO: 214088 - DNA, 25 bp, E. coli
tggaacgactaatacgcatgtcggt

SEQ ID NO: 214089 - DNA, 25 bp, E. coli
taatgatccgatcacgctggtgcgc

SEQ ID NO: 214090 - DNA, 25 bp, E. coli
taatgatccgatgacgctggtgcgc

SEQ ID NO: 214091 - DNA, 25 bp, E. coli
cagatctagtgatgcagcgcgagaa

SEQ ID NO: 214092 - DNA, 25 bp, E. coli
cagaacgctgatatatgccccggaa

SEQ ID NO: 214093 - DNA, 25 bp, E. coli
cagatctagtgaagcagcgcgagaa

SEQ ID NO: 214094 - DNA, 25 bp, E. coli
cagaacgctgatttatgccccggaa

SEQ ID NO: 214095 - DNA, 25 bp, E. coli
ttatgcagaacacgcgtaaacggct

SEQ ID NO: 214096 - DNA, 25 bp, E. coli
ttatgcagaacaggcgtaaacggct

SEQ ID NO: 214097 - DNA, 25 bp, E. coli
tgaagagtaacactgagaacgccgc

SEQ ID NO: 214098 - DNA, 25 bp, E. coli
tgaagagtaacagtgagaacgccgc

SEQ ID NO: 214099 - DNA, 25 bp, E. coli
tcgaaaactatgagcgcaggctgca

SEQ ID NO: 214100 - DNA, 25 bp, E. coli
tcgaaaactatgtgcgcaggctgca

SEQ ID NO: 214101 - DNA, 25 bp, E. coli
taagagggtttatcgcagggatcgc

SEQ ID NO: 214102 - DNA, 25 bp, E. coli
taagagggtttaacgcagggatcgc

SEQ ID NO: 214103 - DNA, 25 bp, E. coli
ccggcgcgtactgaaatgctggact

SEQ ID NO: 214104 - DNA, 25 bp, E. coli
ccggcgcgtactcaaatgctggact

SEQ ID NO: 214105 - DNA, 25 bp, E. coli
tggaatgaggcagtcaaaacccgcg

SEQ ID NO: 214106 - DNA, 25 bp, E. coli
tggaatgaggcactcaaaacccgcg

SEQ ID NO: 214107 - DNA, 25 bp, E. coli
taagccgctggcagctgctgaagaa

SEQ ID NO: 214108 - DNA, 25 bp, E. coli
tcaaaaatgtcaactggcaggcgga

SEQ ID NO: 214109 - DNA, 25 bp, E. coli
tcaaaaatgtcatctggcaggcgga

SEQ ID NO: 214110 - DNA, 25 bp, E. coli
taagccgctggctgctgctgaagaa

SEQ ID NO: 214111 - DNA, 25 bp, E. coli
taaacggcttgaaccccagctgaag

SEQ ID NO: 214112 - DNA, 25 bp, E. coli
taaacggcttgatccccagctgaag

SEQ ID NO: 214113 - DNA, 25 bp, E. coli
taaagccgagcaccggatgcaactg

SEQ ID NO: 214114 - DNA, 25 bp, E. coli
taaagccgagcagcggatgcaactg

SEQ ID NO: 214115 - DNA, 25 bp, E. coli
tattatcttgccaggctaatgcggc

SEQ ID NO: 214116 - DNA, 25 bp, E. coli
tatttagggcgtatgcaccagacgg

SEQ ID NO: 214117 - DNA, 25 bp, E. coli
tattatcttgcctggctaatgcggc

SEQ ID NO: 214118 - DNA, 25 bp, E. coli
tatttagggcgtttgcaccagacgg

SEQ ID NO: 214119 - DNA, 25 bp, E. coli
tgattgaaccttaacgcgccatgcg

SEQ ID NO: 214120 - DNA, 25 bp, E. coli
tgattgaacctttacgcgccatgcg

SEQ ID NO: 214121 - DNA, 25 bp, E. coli
tctgcggctacaaggagactgccac

SEQ ID NO: 214122 - DNA, 25 bp, E. coli
tctgcggctacatggagactgccac

SEQ ID NO: 214123 - DNA, 25 bp, E. coli
cctgaacgttggtcagccgatcaaa

SEQ ID NO: 214124 - DNA, 25 bp, E. coli
cctgaacgttggacagccgatcaaa

SEQ ID NO: 214125 - DNA, 25 bp, E. coli
gctgatcccgcgatcccgaaaaatt

SEQ ID NO: 214126 - DNA, 25 bp, E. coli
gctgatcccgcgttcccgaaaaatt

SEQ ID NO: 214127 - DNA, 25 bp, E. coli
gcacactggcggcaagatttcaccg

SEQ ID NO: 214128 - DNA, 25 bp, E. coli
gcacactggcgggaagatttcaccg

SEQ ID NO: 214129 - DNA, 25 bp, E. coli
gaatttagcgagatcgacaccgctg

SEQ ID NO: 214130 - DNA, 25 bp, E. coli
gaatttagcgagttcgacaccgctg

SEQ ID NO: 214131 - DNA, 25 bp, E. coli
gacagacggcgacttttatagaaca

SEQ ID NO: 214132 - DNA, 25 bp, E. coli
gataccttccggcttgaaagcggca

SEQ ID NO: 214133 - DNA, 25 bp, E. coli
gataccttccgggttgaaagcggca

SEQ ID NO: 214134 - DNA, 25 bp, E. coli
gacagacggcgagttttatagaaca

SEQ ID NO: 214135 - DNA, 25 bp, E. coli
atttgatcttgatgaggcgcagctc

SEQ ID NO: 214136 - DNA, 25 bp, E. coli
atttgatcttgaagaggcgcagctc

SEQ ID NO: 214137 - DNA, 25 bp, E. coli
aacaaccggcgcatgccgaaatgcg

SEQ ID NO: 214138 - DNA, 25 bp, E. coli
aacaaccggcgcttgccgaaatgcg

SEQ ID NO: 214139 - DNA, 25 bp, E. coli
aaatttgatcttgatgaggcgcagc

SEQ ID NO: 214140 - DNA, 25 bp, E. coli
aaatttgatcttcatgaggcgcagc

SEQ ID NO: 214141 - DNA, 25 bp, E. coli
tggtggagatccctgcacaacaggc

SEQ ID NO: 214142 - DNA, 25 bp, E. coli
tggtggagatccgtgcacaacaggc

SEQ ID NO: 214143 - DNA, 25 bp, E. coli
tgatgaggcgcagctcaagccatat

SEQ ID NO: 214144 - DNA, 25 bp, E. coli
tgatgaggcgcacctcaagccatat

SEQ ID NO: 214145 - DNA, 25 bp, E. coli
tctggtggagatccgtgcacaacag

SEQ ID NO: 214146 - DNA, 25 bp, E. coli
tctggtggagatgcgtgcacaacag

SEQ ID NO: 214147 - DNA, 25 bp, E. coli
cgcttgccgaaaagcgcgatcgtgc

SEQ ID NO: 214148 - DNA, 25 bp, E. coli
cgcttgccgaaatgcgcgatcgtgc

SEQ ID NO: 214149 - DNA, 25 bp, E. coli
cttgatgaggcgcagctcaagccat

SEQ ID NO: 214150 - DNA, 25 bp, E. coli
cttgatgaggcggagctcaagccat

SEQ ID NO: 214151 - DNA, 25 bp, E. coli
tggcaaaaacacgtgaagcagcact

SEQ ID NO: 214152 - DNA, 25 bp, E. coli
tggcaaaaacacctgaagcagcact

SEQ ID NO: 214153 - DNA, 25 bp, E. coli
gagaaatttgatgttgatgaggcgc

SEQ ID NO: 214154 - DNA, 25 bp, E. coli
tgatcttgatgaggcgcagctcaag

SEQ ID NO: 214155 - DNA, 25 bp, E. coli
tgatcttgatgacgcgcagctcaag

SEQ ID NO: 214156 - DNA, 25 bp, E. coli
gagaaatttgatcttgatgaggcgc

SEQ ID NO: 214157 - DNA, 25 bp, E. coli
cacaacagaggaaaaaacaatgccg

SEQ ID NO: 214158 - DNA, 25 bp, E. coli
cacaacagaggataaaacaatgccg

SEQ ID NO: 214159 - DNA, 25 bp, E. coli
ttaccgcgcattcctggagacgggc

SEQ ID NO: 214160 - DNA, 25 bp, E. coli
ttaccgcgcattgctggagacgggc

SEQ ID NO: 214161 - DNA, 25 bp, E. coli
tgctgacaacatggagacgatgagc

SEQ ID NO: 214162 - DNA, 25 bp, E. coli
tgctgacaacatcgagacgatgagc

SEQ ID NO: 214163 - DNA, 25 bp, E. coli
tcgtcacggtcaggcatagttacta

SEQ ID NO: 214164 - DNA, 25 bp, E. coli
tcgtcacggtcacgcatagttacta

SEQ ID NO: 214165 - DNA, 25 bp, E. coli
gcgcattaccgggttttcgtcacgg

SEQ ID NO: 214166 - DNA, 25 bp, E. coli
gcgtgataaataccatgctgacaac

SEQ ID NO: 214167 - DNA, 25 bp, E. coli
gcgtgataaatagcatgctgacaac

SEQ ID NO: 214168 - DNA, 25 bp, E. coli
gcgcattaccggcttttcgtcacgg

SEQ ID NO: 214169 - DNA, 25 bp, E. coli
gaatttctgaaacggatcagggact

SEQ ID NO: 214170 - DNA, 25 bp, E. coli
gaatttctgaaagggatcagggact

SEQ ID NO: 214171 - DNA, 25 bp, E. coli
gacgggcgcactcattgaaaaggat

SEQ ID NO: 214172 - DNA, 25 bp, E. coli
gacgggcgcactgattgaaaaggat

SEQ ID NO: 214173 - DNA, 25 bp, E. coli
cggtgaaatgctggcggtaaatcct

SEQ ID NO: 214174 - DNA, 25 bp, E. coli
cggtgaaatgctcgcggtaaatcct

SEQ ID NO: 214175 - DNA, 25 bp, E. coli
gatgagcatcaatgattaccgcgca

SEQ ID NO: 214176 - DNA, 25 bp, E. coli
gagatgtgctctctccggtgaaatg

SEQ ID NO: 214177 - DNA, 25 bp, E. coli
gatgagcatcaaagattaccgcgca

SEQ ID NO: 214178 - DNA, 25 bp, E. coli
gagatgtgctctgtccggtgaaatg

SEQ ID NO: 214179 - DNA, 25 bp, E. coli
caatggaagaaagcggcgcggtact

SEQ ID NO: 214180 - DNA, 25 bp, E. coli
caatggaagaaaccggcgcggtact

SEQ ID NO: 214181 - DNA, 25 bp, E. coli
aaaaagcccctctcctcacggagag

SEQ ID NO: 214182 - DNA, 25 bp, E. coli
aaaaagcccctcacctcacggagag

SEQ ID NO: 214183 - DNA, 25 bp, E. coli
tgattgccgacaaaggcccacaagc

SEQ ID NO: 214184 - DNA, 25 bp, E. coli
tgattgccgacataggcccacaagc

SEQ ID NO: 214185 - DNA, 25 bp, E. coli
tgctgacaaacatgcggcatacatc

SEQ ID NO: 214186 - DNA, 25 bp, E. coli
tgctgacaaacaagcggcatacatc

SEQ ID NO: 214187 - DNA, 25 bp, E. coli
tcggtgccaaactcgtaggccggat

SEQ ID NO: 214188 - DNA, 25 bp, E. coli
tcggtgccaaacacgtaggccggat

SEQ ID NO: 214189 - DNA, 25 bp, E. coli
tcaggcctacaggtcggtgccaaac

SEQ ID NO: 214190 - DNA, 25 bp, E. coli
tcaggcctacagctcggtgccaaac

SEQ ID NO: 214191 - DNA, 25 bp, E. coli
gccctctcgggttaaaacattgatg

SEQ ID NO: 214192 - DNA, 25 bp, E. coli
gccctctcgggtaaaaacattgatg

SEQ ID NO: 214193 - DNA, 25 bp, E. coli
gaactggcagcgctgattgccgaca

SEQ ID NO: 214194 - DNA, 25 bp, E. coli
gaactggcagcggtgattgccgaca

SEQ ID NO: 214195 - DNA, 25 bp, E. coli
ctttgatgctgacaaacatgcggca

SEQ ID NO: 214196 - DNA, 25 bp, E. coli
ctttgatgctgagaaacatgcggca

SEQ ID NO: 214197 - DNA, 25 bp, E. coli
ggtgagggaaaagcctcaccccagc

SEQ ID NO: 214198 - DNA, 25 bp, E. coli
ggtgagggaaaaccctcaccccagc

SEQ ID NO: 214199 - DNA, 25 bp, E. coli
gatgaaggttaatactatgaaagca

SEQ ID NO: 214200 - DNA, 25 bp, E. coli
gatgaaggttaaaactatgaaagca

SEQ ID NO: 214201 - DNA, 25 bp, E. coli
aatgcgcatcgacggtacaactggg

SEQ ID NO: 214202 - DNA, 25 bp, E. coli
aatgcgcatcgagggtacaactggg

SEQ ID NO: 214203 - DNA, 25 bp, E. coli
cacttatgactgaggtgatacttca

SEQ ID NO: 214204 - DNA, 25 bp, E. coli
cacttatgactgtggtgatacttca

SEQ ID NO: 214205 - DNA, 25 bp, E. coli
caggaaaatttcagggcacagccac

SEQ ID NO: 214206 - DNA, 25 bp, E. coli
caggaaaatttctgggcacagccac

SEQ ID NO: 214207 - DNA, 25 bp, E. coli
taaaaactcgttccaaatgcgcatc

SEQ ID NO: 214208 - DNA, 25 bp, E. coli
taaaaactcgttgcaaatgcgcatc

SEQ ID NO: 214209 - DNA, 25 bp, E. coli
caatgccatgcctgacggttttact

SEQ ID NO: 214210 - DNA, 25 bp, E. coli
caatgccatgccagacggttttact

SEQ ID NO: 214211 - DNA, 25 bp, E. coli
ttcgtattgaaaatctcggcggcgg

SEQ ID NO: 214212 - DNA, 25 bp, E. coli
ttcgtattgaaattctcggcggcgg

SEQ ID NO: 214213 - DNA, 25 bp, E. coli
tgcgcgcctggcgagttaatctggt

SEQ ID NO: 214214 - DNA, 25 bp, E. coli
tgcgcgcctggccagttaatctggt

SEQ ID NO: 214215 - DNA, 25 bp, E. coli
tcggcggcggagatgcaaatattcc

SEQ ID NO: 214216 - DNA, 25 bp, E. coli
tcggcggcggagttgcaaatattcc

SEQ ID NO: 214217 - DNA, 25 bp, E. coli
ccgttgatccttgcgggcatggcac

SEQ ID NO: 214218 - DNA, 25 bp, E. coli
ccgttgatccttccgggcatggcac

SEQ ID NO: 214219 - DNA, 25 bp, E. coli
ggtcagaagtttaccacccgcaatg

SEQ ID NO: 214220 - DNA, 25 bp, E. coli
ggtcagaagttttccacccgcaatg

SEQ ID NO: 214221 - DNA, 25 bp, E. coli
tggcaccgtcaaaatgcgcgcctgg

SEQ ID NO: 214222 - DNA, 25 bp, E. coli
tggcaccgtcaatatgcgcgcctgg

SEQ ID NO: 214223 - DNA, 25 bp, E. coli
cacgtacgctggttattgaccgggt

SEQ ID NO: 214224 - DNA, 25 bp, E. coli
cacgtacgctggatattgaccgggt

SEQ ID NO: 214225 - DNA, 25 bp, E. coli
agagcttgctactcttcggcggatg

SEQ ID NO: 214226 - DNA, 25 bp, E. coli
agagcttgctacacttcggcggatg

SEQ ID NO: 214227 - DNA, 25 bp, E. coli
aaagcggcggagattctgcgtcagc

SEQ ID NO: 214228 - DNA, 25 bp, E. coli
aaagcggcggagtttctgcgtcagc

SEQ ID NO: 214229 - DNA, 25 bp, E. coli
ttgaccgggtgcagtcgatgatgcc

SEQ ID NO: 214230 - DNA, 25 bp, E. coli
ttgaccgggtgctgtcgatgatgcc

SEQ ID NO: 214231 - DNA, 25 bp, E. coli
ttttaacgaaacacaggcacaggag

SEQ ID NO: 214232 - DNA, 25 bp, E. coli
ttttaacgaaactcaggcacaggag

SEQ ID NO: 214233 - DNA, 25 bp, E. coli
tgatgcctgaatgcggaattgaacc

SEQ ID NO: 214234 - DNA, 25 bp, E. coli
tgatgcctgaatccggaattgaacc

SEQ ID NO: 214235 - DNA, 25 bp, E. coli
gctattacgatctctcgcaggcagg

SEQ ID NO: 214236 - DNA, 25 bp, E. coli
gctattacgatcactcgcaggcagg

SEQ ID NO: 214237 - DNA, 25 bp, E. coli
gaacgaaattttccgccagaaagcg

SEQ ID NO: 214238 - DNA, 25 bp, E. coli
gaacgaaattttgcgccagaaagcg

SEQ ID NO: 214239 - DNA, 25 bp, E. coli
cattgatgatgcttctctggcgcgt

SEQ ID NO: 214240 - DNA, 25 bp, E. coli
cattgatgatgcatctctggcgcgt

SEQ ID NO: 214241 - DNA, 25 bp, E. coli
gattcgcgttgggactgcacaagag

SEQ ID NO: 214242 - DNA, 25 bp, E. coli
gattcgcgttggcactgcacaagag

SEQ ID NO: 214243 - DNA, 25 bp, E. coli
tcagcaacggtacatgaagaaacct

SEQ ID NO: 214244 - DNA, 25 bp, E. coli
tcagcaacggtagatgaagaaacct

SEQ ID NO: 214245 - DNA, 25 bp, E. coli
catggaaatgcgtcaaaatccgcga

SEQ ID NO: 214246 - DNA, 25 bp, E. coli
catggaaatgcgacaaaatccgcga

SEQ ID NO: 214247 - DNA, 25 bp, E. coli
acgtgaagatgtggcaaaggtcgcc

SEQ ID NO: 214248 - DNA, 25 bp, E. coli
acgtgaagatgtcgcaaaggtcgcc

SEQ ID NO: 214249 - DNA, 25 bp, E. coli
tgttccgggtgagaatacatccagc

SEQ ID NO: 214250 - DNA, 25 bp, E. coli
tgttccgggtgacaatacatccagc

SEQ ID NO: 214251 - DNA, 25 bp, E. coli
tgaaccgcctggtgcttagcatggg

SEQ ID NO: 214252 - DNA, 25 bp, E. coli
tgaaccgcctggagcttagcatggg

SEQ ID NO: 214253 - DNA, 25 bp, E. coli
tcttgaagccgatacgttgagcgga

SEQ ID NO: 214254 - DNA, 25 bp, E. coli
tcttgaagccgaaacgttgagcgga

SEQ ID NO: 214255 - DNA, 25 bp, E. coli
gaattgcactttgcggacgtgaaga

SEQ ID NO: 214256 - DNA, 25 bp, E. coli
gaattgcactttccggacgtgaaga

SEQ ID NO: 214257 - DNA, 25 bp, E. coli
gaatttcttgccgagcatcaggagt

SEQ ID NO: 214258 - DNA, 25 bp, E. coli
gaatttcttgcccagcatcaggagt

SEQ ID NO: 214259 - DNA, 25 bp, E. coli
gaaacgcctgtatttattgatccgg

SEQ ID NO: 214260 - DNA, 25 bp, E. coli
gaaacgcctgtaattattgatccgg

SEQ ID NO: 214261 - DNA, 25 bp, E. coli
cgtgctatgcgccaaaaggactaca

SEQ ID NO: 214262 - DNA, 25 bp, E. coli
cgtgctatgcgcgaaaaggactaca

SEQ ID NO: 214263 - DNA, 25 bp, E. coli
tggcgcaaactaatcaatccggtgt

SEQ ID NO: 214264 - DNA, 25 bp, E. coli
tggcgcaaactattcaatccggtgt

SEQ ID NO: 214265 - DNA, 25 bp, E. coli
taatacaggagaaatgcttgtcgcg

SEQ ID NO: 214266 - DNA, 25 bp, E. coli
taatacaggagatatgcttgtcgcg

SEQ ID NO: 214267 - DNA, 25 bp, E. coli
cactggctgaatcggcagagaaaca

SEQ ID NO: 214268 - DNA, 25 bp, E. coli
cactggctgaatgggcagagaaaca

SEQ ID NO: 214269 - DNA, 25 bp, E. coli
aaatataactgtcaacgcccgcatg

SEQ ID NO: 214270 - DNA, 25 bp, E. coli
aaatataactgtgaacgcccgcatg

SEQ ID NO: 214271 - DNA, 25 bp, E. coli
tgtactcgacaggatcgcggcaaac

SEQ ID NO: 214272 - DNA, 25 bp, E. coli
tgtactcgacagcatcgcggcaaac

SEQ ID NO: 214273 - DNA, 25 bp, E. coli
tgacaccggaggaataccgacagcg

SEQ ID NO: 214274 - DNA, 25 bp, E. coli
tgaatctgccaggtcagcgagtggt

SEQ ID NO: 214275 - DNA, 25 bp, E. coli
tgcttcgtctggttaacggcccgga

SEQ ID NO: 214276 - DNA, 25 bp, E. coli
tgcttcgtctggataacggcccgga

SEQ ID NO: 214277 - DNA, 25 bp, E. coli
tgagcgctttaaccggacataccga

SEQ ID NO: 214278 - DNA, 25 bp, E. coli
tgaatctgccagctcagcgagtggt

SEQ ID NO: 214279 - DNA, 25 bp, E. coli
tgagcgctttaagcggacataccga

SEQ ID NO: 214280 - DNA, 25 bp, E. coli
tgacaccggaggtataccgacagcg

SEQ ID NO: 214281 - DNA, 25 bp, E. coli
gaatttatctccgtggcactggctg

SEQ ID NO: 214282 - DNA, 25 bp, E. coli
gaatttatctccctggcactggctg

SEQ ID NO: 214283 - DNA, 25 bp, E. coli
ggtaagccgacggagaacgctttca

SEQ ID NO: 214284 - DNA, 25 bp, E. coli
ggtaagccgacgcagaacgctttca

SEQ ID NO: 214285 - DNA, 25 bp, E. coli
tggccgggatctgaaaaagtgtatg

SEQ ID NO: 214286 - DNA, 25 bp, E. coli
tggccgggatctcaaaaagtgtatg

SEQ ID NO: 214287 - DNA, 25 bp, E. coli
tggagtttatcctgccgggtaagcc

SEQ ID NO: 214288 - DNA, 25 bp, E. coli
tggagtttatccagccgggtaagcc

SEQ ID NO: 214289 - DNA, 25 bp, E. coli
cacagaggactgtgagggtatccag

SEQ ID NO: 214290 - DNA, 25 bp, E. coli
cacagaggactgagagggtatccag

SEQ ID NO: 214291 - DNA, 25 bp, E. coli
tattattaagcgaatcccagtgaga

SEQ ID NO: 214292 - DNA, 25 bp, E. coli
tattattaagcgtatcccagtgaga

SEQ ID NO: 214293 - DNA, 25 bp, E. coli
tttaaaatttgacacggaacgccat

SEQ ID NO: 214294 - DNA, 25 bp, E. coli
tttaaaatttgagacggaacgccat

SEQ ID NO: 214295 - DNA, 25 bp, E. coli
tgcatcaagtgatatctgccgctct

SEQ ID NO: 214296 - DNA, 25 bp, E. coli
tgcatcaagtgaaatctgccgctct

SEQ ID NO: 214297 - DNA, 25 bp, E. coli
tccggtgggagggtacactaagctt

SEQ ID NO: 214298 - DNA, 25 bp, E. coli
tccggtgggaggctacactaagctt

SEQ ID NO: 214299 - DNA, 25 bp, E. coli
tcatatcggtggtaatgcgtacaca

SEQ ID NO: 214300 - DNA, 25 bp, E. coli
tcatatcggtggaaatgcgtacaca

SEQ ID NO: 214301 - DNA, 25 bp, E. coli
gatcgctatcaacgtattccggtgg

SEQ ID NO: 214302 - DNA, 25 bp, E. coli
gattctctagcgagtaaagcccata

SEQ ID NO: 214303 - DNA, 25 bp, E. coli
gattctctagcgtgtaaagcccata

SEQ ID NO: 214304 - DNA, 25 bp, E. coli
gggaggacttattccaagcattgat

SEQ ID NO: 214305 - DNA, 25 bp, E. coli
gggaggacttataccaagcattgat

SEQ ID NO: 214306 - DNA, 25 bp, E. coli
tggacccattgaacagtacttcgac

SEQ ID NO: 214307 - DNA, 25 bp, E. coli
tggacccattgatcagtacttcgac

SEQ ID NO: 214308 - DNA, 25 bp, E. coli
gagtggaaagttggcgacgaaccct

SEQ ID NO: 214309 - DNA, 25 bp, E. coli
gatcgctatcaaggtattccggtgg

SEQ ID NO: 214310 - DNA, 25 bp, E. coli
gagtggaaagttcgcgacgaaccct

SEQ ID NO: 214311 - DNA, 25 bp, E. coli
aataaaattgcacaaacgacagcgc

SEQ ID NO: 214312 - DNA, 25 bp, E. coli
aataaaattgcagaaacgacagcgc

SEQ ID NO: 214313 - DNA, 25 bp, E. coli
taaacacgactcagagagtgtggca

SEQ ID NO: 214314 - DNA, 25 bp, E. coli
taaacacgactctgagagtgtggca

SEQ ID NO: 214315 - DNA, 25 bp, E. coli
tatcaggccttgagaaagactggga

SEQ ID NO: 214316 - DNA, 25 bp, E. coli
tatatttacgctgaacacggtccac

SEQ ID NO: 214317 - DNA, 25 bp, E. coli
tatcaggccttgtgaaagactggga

SEQ ID NO: 214318 - DNA, 25 bp, E. coli
tatatttacgctcaacacggtccac

SEQ ID NO: 214319 - DNA, 25 bp, E. coli
tccggcggaatacctggcaagagtc

SEQ ID NO: 214320 - DNA, 25 bp, E. coli
tccggcggaatagctggcaagagtc

SEQ ID NO: 214321 - DNA, 25 bp, E. coli
gctgcactggaaccttcggcatgta

SEQ ID NO: 214322 - DNA, 25 bp, E. coli
gctgcactggaagcttcggcatgta

SEQ ID NO: 214323 - DNA, 25 bp, E. coli
gaattcgtggcgaaattccggcgga

SEQ ID NO: 214324 - DNA, 25 bp, E. coli
gaattcgtggcgtaattccggcgga

SEQ ID NO: 214325 - DNA, 25 bp, E. coli
gactgggatgcagaaaaacgctgga

SEQ ID NO: 214326 - DNA, 25 bp, E. coli
gactgggatgcacaaaaacgctgga

SEQ ID NO: 214327 - DNA, 25 bp, E. coli
gattgcagcacagacacttcgtcat

SEQ ID NO: 214328 - DNA, 25 bp, E. coli
gttattcagtaagagagccgctgca

SEQ ID NO: 214329 - DNA, 25 bp, E. coli
gttattcagtaacagagccgctgca

SEQ ID NO: 214330 - DNA, 25 bp, E. coli
gattgcagcacacacacttcgtcat

SEQ ID NO: 214331 - DNA, 25 bp, E. coli
taacggtttcttgatggtatcaggc

SEQ ID NO: 214332 - DNA, 25 bp, E. coli
taacggtttcttcatggtatcaggc

SEQ ID NO: 214333 - DNA, 25 bp, E. coli
atacctgcgaggaaacggattctgc

SEQ ID NO: 214334 - DNA, 25 bp, E. coli
acctgcgaggtatcggattctgcag

SEQ ID NO: 214335 - DNA, 25 bp, E. coli
atacctgcgaggtaacggattctgc

SEQ ID NO: 214336 - DNA, 25 bp, E. coli
acctgcgaggtaacggattctgcag

SEQ ID NO: 214337 - DNA, 25 bp, E. coli
tacctgcgaggtaacggattctgca

SEQ ID NO: 214338 - DNA, 25 bp, E. coli
tacctgcgaggttacggattctgca

SEQ ID NO: 214339 - DNA, 25 bp, E. coli
tatacctgcgagctaacggattctg

SEQ ID NO: 214340 - DNA, 25 bp, E. coli
tatacctgcgaggtaacggattctg

SEQ ID NO: 214341 - DNA, 25 bp, E. coli
ttatacctgcgaggtaacggattct

SEQ ID NO: 214342 - DNA, 25 bp, E. coli
ttatacctgcgacgtaacggattct

SEQ ID NO: 214343 - DNA, 25 bp, E. coli
tgcgaggtaacgcattctgcagaac

SEQ ID NO: 214344 - DNA, 25 bp, E. coli
tgcgaggtaacggattctgcagaac

SEQ ID NO: 214345 - DNA, 25 bp, E. coli
cctgcgaggtaagggattctgcaga

SEQ ID NO: 214346 - DNA, 25 bp, E. coli
cctgcgaggtaacggattctgcaga

SEQ ID NO: 214347 - DNA, 25 bp, E. coli
gcttatacctgccaggtaacggatt

SEQ ID NO: 214348 - DNA, 25 bp, E. coli
gcgaggtaacggtttctgcagaaca

SEQ ID NO: 214349 - DNA, 25 bp, E. coli
gcttatacctgcgaggtaacggatt

SEQ ID NO: 214350 - DNA, 25 bp, E. coli
gcgaggtaacggattctgcagaaca

SEQ ID NO: 214351 - DNA, 25 bp, E. coli
cttatacctgcgaggtaacggattc

SEQ ID NO: 214352 - DNA, 25 bp, E. coli
cttatacctgcgtggtaacggattc

SEQ ID NO: 214353 - DNA, 25 bp, E. coli
gggcttatacctccgaggtaacgga

SEQ ID NO: 214354 - DNA, 25 bp, E. coli
gggcttatacctgcgaggtaacgga

SEQ ID NO: 214355 - DNA, 25 bp, E. coli
caggagttacttgcgcaacttggcg

SEQ ID NO: 214356 - DNA, 25 bp, E. coli
caggagttacttccgcaacttggcg

SEQ ID NO: 214357 - DNA, 25 bp, E. coli
caacttggcgtgtcctttgaacgta

SEQ ID NO: 214358 - DNA, 25 bp, E. coli
caacttggcgtgacctttgaacgta

SEQ ID NO: 214359 - DNA, 25 bp, E. coli
taaagcaggtgcatacggtattcag

SEQ ID NO: 214360 - DNA, 25 bp, E. coli
taaagcaggtgcttacggtattcag

SEQ ID NO: 214361 - DNA, 25 bp, E. coli
tttgtcaggaagttaaatggcagct

SEQ ID NO: 214362 - DNA, 25 bp, E. coli
tttgtcaggaagataaatggcagct

SEQ ID NO: 214363 - DNA, 25 bp, E. coli
ttaacagacgaagacatcgcgggct

SEQ ID NO: 214364 - DNA, 25 bp, E. coli
ttacgggcattgtggagcagcgtca

SEQ ID NO: 214365 - DNA, 25 bp, E. coli
ttacgggcattgaggagcagcgtca

SEQ ID NO: 214366 - DNA, 25 bp, E. coli
ttaacagacgaacacatcgcgggct

SEQ ID NO: 214367 - DNA, 25 bp, E. coli
tgtatttagcttgcggttctccgcg

SEQ ID NO: 214368 - DNA, 25 bp, E. coli
tgtatttagcttccggttctccgcg

SEQ ID NO: 214369 - DNA, 25 bp, E. coli
tcgggtcagaccgatcaggtgatga

SEQ ID NO: 214370 - DNA, 25 bp, E. coli
tctcgattgcctggtggtcaccgat

SEQ ID NO: 214371 - DNA, 25 bp, E. coli
tctcgattgcctcgtggtcaccgat

SEQ ID NO: 214372 - DNA, 25 bp, E. coli
tcgggtcagacccatcaggtgatga

SEQ ID NO: 214373 - DNA, 25 bp, E. coli
cgtagtcggctttccgctggttgaa

SEQ ID NO: 214374 - DNA, 25 bp, E. coli
cgtagtcggcttaccgctggttgaa

SEQ ID NO: 214375 - DNA, 25 bp, E. coli
gatgttgcgcaatttatcgggtcag

SEQ ID NO: 214376 - DNA, 25 bp, E. coli
gatgttgcgcaaattatcgggtcag

SEQ ID NO: 214377 - DNA, 25 bp, E. coli
caaaaccgatatcgtggttagcggc

SEQ ID NO: 214378 - DNA, 25 bp, E. coli
caaattttgatgatgccgctggtct

SEQ ID NO: 214379 - DNA, 25 bp, E. coli
caaaaccgatatggtggttagcggc

SEQ ID NO: 214380 - DNA, 25 bp, E. coli
caaattttgatgttgccgctggtct

SEQ ID NO: 214381 - DNA, 25 bp, E. coli
tatcgtctgcgacatatggcgaaac

SEQ ID NO: 214382 - DNA, 25 bp, E. coli
tattgttgggatgcgtttgtacggc

SEQ ID NO: 214383 - DNA, 25 bp, E. coli
tattgttgggatccgtttgtacggc

SEQ ID NO: 214384 - DNA, 25 bp, E. coli
tatcgtctgcgagatatggcgaaac

SEQ ID NO: 214385 - DNA, 25 bp, E. coli
tggtcaatattcatgcctccgcgct

SEQ ID NO: 214386 - DNA, 25 bp, E. coli
tggtcaatattcttgcctccgcgct

SEQ ID NO: 214387 - DNA, 25 bp, E. coli
tgcgactggtgtcctgacttttgtc

SEQ ID NO: 214388 - DNA, 25 bp, E. coli
tgcgactggtgtgctgacttttgtc

SEQ ID NO: 214389 - DNA, 25 bp, E. coli
gctatcacccgtatgctgatgcgca

SEQ ID NO: 214390 - DNA, 25 bp, E. coli
gctatcacccgtttgctgatgcgca

SEQ ID NO: 214391 - DNA, 25 bp, E. coli
cgctggtctggttgctgaatgctat

SEQ ID NO: 214392 - DNA, 25 bp, E. coli
cgaaacagggtaatcgctcggccaa

SEQ ID NO: 214393 - DNA, 25 bp, E. coli
cgaaacagggtattcgctcggccaa

SEQ ID NO: 214394 - DNA, 25 bp, E. coli
cgctggtctggtagctgaatgctat

SEQ ID NO: 214395 - DNA, 25 bp, E. coli
ctccgcgctcgggactattgttggg

SEQ ID NO: 214396 - DNA, 25 bp, E. coli
ctccgcgctcggcactattgttggg

SEQ ID NO: 214397 - DNA, 25 bp, E. coli
ggttagcggctctttgagcaaagaa

SEQ ID NO: 214398 - DNA, 25 bp, E. coli
ggttagcggctcattgagcaaagaa

SEQ ID NO: 214399 - DNA, 25 bp, E. coli
cagtgtgctgttacgtgccagtgcg

SEQ ID NO: 214400 - DNA, 25 bp, E. coli
cagtgtgctgtttcgtgccagtgcg

SEQ ID NO: 214401 - DNA, 25 bp, E. coli
tactacgctgtcacgaatcattcgc

SEQ ID NO: 214402 - DNA, 25 bp, E. coli
tactacgctgtctcgaatcattcgc

SEQ ID NO: 214403 - DNA, 25 bp, E. coli
acgaatcattcgcatggtgcgccag

SEQ ID NO: 214404 - DNA, 25 bp, E. coli
acgaatcattcggatggtgcgccag

SEQ ID NO: 214405 - DNA, 25 bp, E. coli
tattacgaagccagcgcgatgatta

SEQ ID NO: 214406 - DNA, 25 bp, E. coli
tattacgaagcctgcgcgatgatta

SEQ ID NO: 214407 - DNA, 25 bp, E. coli
tgagcaacaggttggtaccaaagct

SEQ ID NO: 214408 - DNA, 25 bp, E. coli
tgagcaacaggtaggtaccaaagct

SEQ ID NO: 214409 - DNA, 25 bp, E. coli
tcttgaacagcgtccggatgttgag

SEQ ID NO: 214410 - DNA, 25 bp, E. coli
tcttgaacagcgaccggatgttgag

SEQ ID NO: 214411 - DNA, 25 bp, E. coli
ccaaagctatcgaagcggagattac

SEQ ID NO: 214412 - DNA, 25 bp, E. coli
ccaaagctatcgtagcggagattac

SEQ ID NO: 214413 - DNA, 25 bp, E. coli
gcgttcttctaaggcgctggaaaag

SEQ ID NO: 214414 - DNA, 25 bp, E. coli
gcgttcttctaacgcgctggaaaag

SEQ ID NO: 214415 - DNA, 25 bp, E. coli
cgtgcctctggctgaagtgcagcca

SEQ ID NO: 214416 - DNA, 25 bp, E. coli
cgtgcctctggcagaagtgcagcca

SEQ ID NO: 214417 - DNA, 25 bp, E. coli
ggaagcgcgacatctttattacgaa

SEQ ID NO: 214418 - DNA, 25 bp, E. coli
ggagattactgcacaggcatcgcaa

SEQ ID NO: 214419 - DNA, 25 bp, E. coli
ggagattactgctcaggcatcgcaa

SEQ ID NO: 214420 - DNA, 25 bp, E. coli
ggaagcgcgacaactttattacgaa

SEQ ID NO: 214421 - DNA, 25 bp, E. coli
caacgagcgcgttgttatctgatag

SEQ ID NO: 214422 - DNA, 25 bp, E. coli
caacgagcgcgtagttatctgatag

SEQ ID NO: 214423 - DNA, 25 bp, E. coli
tttgcgtaatccagagtcgctggcg

SEQ ID NO: 214424 - DNA, 25 bp, E. coli
tatctgataggtgaaacggcggtag

SEQ ID NO: 214425 - DNA, 25 bp, E. coli
tttgcgtaatcctgagtcgctggcg

SEQ ID NO: 214426 - DNA, 25 bp, E. coli
tatctgataggtcaaacggcggtag

SEQ ID NO: 214427 - DNA, 25 bp, E. coli
tgtttatccgctggcaacgccgggt

SEQ ID NO: 214428 - DNA, 25 bp, E. coli
tgtttatccgctcgcaacgccgggt

SEQ ID NO: 214429 - DNA, 25 bp, E. coli
tcctccgtggaatacgtggtctggt

SEQ ID NO: 214430 - DNA, 25 bp, E. coli
tcctccgtggaaaacgtggtctggt

SEQ ID NO: 214431 - DNA, 25 bp, E. coli
ccatcttattacctccgggagacag

SEQ ID NO: 214432 - DNA, 25 bp, E. coli
ccatcttattacgtccgggagacag

SEQ ID NO: 214433 - DNA, 25 bp, E. coli
gctggatgccatagagcgtttgcaa

SEQ ID NO: 214434 - DNA, 25 bp, E. coli
gctggatgccattgagcgtttgcaa

SEQ ID NO: 214435 - DNA, 25 bp, E. coli
gatatgccgaatctggttgaagcca

SEQ ID NO: 214436 - DNA, 25 bp, E. coli
gatatgccgaatgtggttgaagcca

SEQ ID NO: 214437 - DNA, 25 bp, E. coli
ggttgttgaattccactcctccgtg

SEQ ID NO: 214438 - DNA, 25 bp, E. coli
ggttgttgaattgcactcctccgtg

SEQ ID NO: 214439 - DNA, 25 bp, E. coli
gagtttgccggatcaactacacacg

SEQ ID NO: 214440 - DNA, 25 bp, E. coli
gagtttgccggaacaactacacacg

SEQ ID NO: 214441 - DNA, 25 bp, E. coli
gagtctcgctttattgaaattccgg

SEQ ID NO: 214442 - DNA, 25 bp, E. coli
gagtctcgcttttttgaaattccgg

SEQ ID NO: 214443 - DNA, 25 bp, E. coli
tatgtgatgacggtttacgcgcagg

SEQ ID NO: 214444 - DNA, 25 bp, E. coli
tatgtgatgacgctttacgcgcagg

SEQ ID NO: 214445 - DNA, 25 bp, E. coli
tttacgcgcagggcgtgctgacgcc

SEQ ID NO: 214446 - DNA, 25 bp, E. coli
tttacgcgcaggccgtgctgacgcc

SEQ ID NO: 214447 - DNA, 25 bp, E. coli
tgaaaaccgcttgcgtcataatgaa

SEQ ID NO: 214448 - DNA, 25 bp, E. coli
tgaaaaccgcttccgtcataatgaa

SEQ ID NO: 214449 - DNA, 25 bp, E. coli
tgctgaagagtactttggtgccagc

SEQ ID NO: 214450 - DNA, 25 bp, E. coli
tgctgaagagtagtttggtgccagc

SEQ ID NO: 214451 - DNA, 25 bp, E. coli
tctgctgaagagtactttggtgcca

SEQ ID NO: 214452 - DNA, 25 bp, E. coli
tctgctgaagagaactttggtgcca

SEQ ID NO: 214453 - DNA, 25 bp, E. coli
gaagagcattacgacgactatgtga

SEQ ID NO: 214454 - DNA, 25 bp, E. coli
gaagagcattaccacgactatgtga

SEQ ID NO: 214455 - DNA, 25 bp, E. coli
cgtcataatgaatgcggcagcctgg

SEQ ID NO: 214456 - DNA, 25 bp, E. coli
ctcgctttctgcagaagagtacttt

SEQ ID NO: 214457 - DNA, 25 bp, E. coli
ctcgctttctgctgaagagtacttt

SEQ ID NO: 214458 - DNA, 25 bp, E. coli
cattacgacgactatgtgatgacgc

SEQ ID NO: 214459 - DNA, 25 bp, E. coli
cattacgacgacaatgtgatgacgc

SEQ ID NO: 214460 - DNA, 25 bp, E. coli
cgtcataatgaaagcggcagcctgg

SEQ ID NO: 214461 - DNA, 25 bp, E. coli
gattgatgaaaagcgcttccgtcat

SEQ ID NO: 214462 - DNA, 25 bp, E. coli
gattgatgaaaaccgcttccgtcat

SEQ ID NO: 214463 - DNA, 25 bp, E. coli
gacgactatgtgttgacgctttacg

SEQ ID NO: 214464 - DNA, 25 bp, E. coli
gacgactatgtgatgacgctttacg

SEQ ID NO: 214465 - DNA, 25 bp, E. coli
cagcatgctaagcaaggctttccca

SEQ ID NO: 214466 - DNA, 25 bp, E. coli
cagcatgctaaggaaggctttccca

SEQ ID NO: 214467 - DNA, 25 bp, E. coli
atcctgtacgggtagcgcaacacca

SEQ ID NO: 214468 - DNA, 25 bp, E. coli
atcctgtacgggaagcgcaacacca

SEQ ID NO: 214469 - DNA, 25 bp, E. coli
taccgcatcctgtacgggtagcgca

SEQ ID NO: 214470 - DNA, 25 bp, E. coli
taccgcatcctgaacgggtagcgca

SEQ ID NO: 214471 - DNA, 25 bp, E. coli
tcactacgactatttgggagcgaga

SEQ ID NO: 214472 - DNA, 25 bp, E. coli
tcactacgactaattgggagcgaga

SEQ ID NO: 214473 - DNA, 25 bp, E. coli
gcaacaccagcaagctaagcaaggc

SEQ ID NO: 214474 - DNA, 25 bp, E. coli
gcaacaccagcatgctaagcaaggc

SEQ ID NO: 214475 - DNA, 25 bp, E. coli
ctatttgggagcgagatggaatgca

SEQ ID NO: 214476 - DNA, 25 bp, E. coli
ctatttgggagccagatggaatgca

SEQ ID NO: 214477 - DNA, 25 bp, E. coli
gatttcactacgtctatttgggagc

SEQ ID NO: 214478 - DNA, 25 bp, E. coli
gatttcactacgactatttgggagc

SEQ ID NO: 214479 - DNA, 25 bp, E. coli
gtgttaccgcatgctgtacgggtag

SEQ ID NO: 214480 - DNA, 25 bp, E. coli
gtgttaccgcatcctgtacgggtag

SEQ ID NO: 214481 - DNA, 25 bp, E. coli
gggtagcgcaactccagcatgctaa

SEQ ID NO: 214482 - DNA, 25 bp, E. coli
gggtagcgcaacaccagcatgctaa

SEQ ID NO: 214483 - DNA, 25 bp, E. coli
ggctttcccatcagatttcactacg

SEQ ID NO: 214484 - DNA, 25 bp, E. coli
ggctttcccatctgatttcactacg

SEQ ID NO: 214485 - DNA, 25 bp, E. coli
taagcaaggcttacccatcagattt

SEQ ID NO: 214486 - DNA, 25 bp, E. coli
taagcaaggctttcccatcagattt

SEQ ID NO: 214487 - DNA, 25 bp, E. coli
caacagtccgaaaatcgcagcagca

SEQ ID NO: 214488 - DNA, 25 bp, E. coli
caacagtccgaatatcgcagcagca

SEQ ID NO: 214489 - DNA, 25 bp, E. coli
cacgttttgaatcggtgcatcgtca

SEQ ID NO: 214490 - DNA, 25 bp, E. coli
cacgttttgaatgggtgcatcgtca

SEQ ID NO: 214491 - DNA, 25 bp, E. coli
aaaagcctgaaaacaccacgcagtg

SEQ ID NO: 214492 - DNA, 25 bp, E. coli
aaaagcctgaaatcaccacgcagtg

SEQ ID NO: 214493 - DNA, 25 bp, E. coli
tcctggcacagcaggaaaaaagcct

SEQ ID NO: 214494 - DNA, 25 bp, E. coli
tcctggcacagctggaaaaaagcct

SEQ ID NO: 214495 - DNA, 25 bp, E. coli
tcgtcacggttgaatcagaactccc

SEQ ID NO: 214496 - DNA, 25 bp, E. coli
tcgtcacggttgtatcagaactccc

SEQ ID NO: 214497 - DNA, 25 bp, E. coli
gaccacgttcgaccatatcgtcacg

SEQ ID NO: 214498 - DNA, 25 bp, E. coli
gaccacgttcgagcatatcgtcacg

SEQ ID NO: 214499 - DNA, 25 bp, E. coli
cgcgcgaggagtggcaaagaaaact

SEQ ID NO: 214500 - DNA, 25 bp, E. coli
cgcgtgttctctatgccggaggtaa

SEQ ID NO: 214501 - DNA, 25 bp, E. coli
cgcgcgaggagtcgcaaagaaaact

SEQ ID NO: 214502 - DNA, 25 bp, E. coli
cgcgtgttctctttgccggaggtaa

SEQ ID NO: 214503 - DNA, 25 bp, E. coli
gattgcccgcgtgtggtacaaagga

SEQ ID NO: 214504 - DNA, 25 bp, E. coli
gattgcccgcgtctggtacaaagga

SEQ ID NO: 214505 - DNA, 25 bp, E. coli
tcaaacgtccggtgaaggtgcagcc

SEQ ID NO: 214506 - DNA, 25 bp, E. coli
tcaaacgtccggagaaggtgcagcc

SEQ ID NO: 214507 - DNA, 25 bp, E. coli
gatgccgacaatctgcagcaccgtt

SEQ ID NO: 214508 - DNA, 25 bp, E. coli
gatgccgacaatgtgcagcaccgtt

SEQ ID NO: 214509 - DNA, 25 bp, E. coli
cagttaccggagaccatgccagagc

SEQ ID NO: 214510 - DNA, 25 bp, E. coli
cagttaccggagtccatgccagagc

SEQ ID NO: 214511 - DNA, 25 bp, E. coli
tacaaggaatgcctgatgaccccgc

SEQ ID NO: 214512 - DNA, 25 bp, E. coli
tacaaggaatgcgtgatgaccccgc

SEQ ID NO: 214513 - DNA, 25 bp, E. coli
tatgccacgcgatttctgccgaaga

SEQ ID NO: 214514 - DNA, 25 bp, E. coli
tatgccacgcgaattctgccgaaga

SEQ ID NO: 214515 - DNA, 25 bp, E. coli
tatcgtcgcgatctgctgcaaaact

SEQ ID NO: 214516 - DNA, 25 bp, E. coli
tatcgtcgcgatgtgctgcaaaact

SEQ ID NO: 214517 - DNA, 25 bp, E. coli
ttgggtggcaacagacgatcagcgt

SEQ ID NO: 214518 - DNA, 25 bp, E. coli
ttgggtggcaactgacgatcagcgt

SEQ ID NO: 214519 - DNA, 25 bp, E. coli
tgacgcgcaacgttcatgaatccgg

SEQ ID NO: 214520 - DNA, 25 bp, E. coli
tgacgcgcaacgatcatgaatccgg

SEQ ID NO: 214521 - DNA, 25 bp, E. coli
tcagcgtgttgaaaaggccgtgcag

SEQ ID NO: 214522 - DNA, 25 bp, E. coli
tcagcgtgttgataaggccgtgcag

SEQ ID NO: 214523 - DNA, 25 bp, E. coli
cccacgggatgtaggaacgctgtta

SEQ ID NO: 214524 - DNA, 25 bp, E. coli
cccacgggatgttggaacgctgtta

SEQ ID NO: 214525 - DNA, 25 bp, E. coli
cattcgcacgttagagattgccgca

SEQ ID NO: 214526 - DNA, 25 bp, E. coli
cattcgcacgtttgagattgccgca

SEQ ID NO: 214527 - DNA, 25 bp, E. coli
gatatcaacatttacctgcagggcg

SEQ ID NO: 214528 - DNA, 25 bp, E. coli
gatatcaacattaacctgcagggcg

SEQ ID NO: 214529 - DNA, 25 bp, E. coli
taatgctgaaaatgcgcgctacctg

SEQ ID NO: 214530 - DNA, 25 bp, E. coli
taatgctgaaaaagcgcgctacctg

SEQ ID NO: 214531 - DNA, 25 bp, E. coli
aatgacacgtcgtcacggcgacgaa

SEQ ID NO: 214532 - DNA, 25 bp, E. coli
aatgacacgtcgacacggcgacgaa

SEQ ID NO: 214533 - DNA, 25 bp, E. coli
taaaagttggcacaaaaaatgctta

SEQ ID NO: 214534 - DNA, 25 bp, E. coli
taaaagttggcagaaaaaatgctta

SEQ ID NO: 214535 - DNA, 25 bp, E. coli
tgtcgatgatgtcgaaatgacacgt

SEQ ID NO: 214536 - DNA, 25 bp, E. coli
tgtcgatgatgtggaaatgacacgt

SEQ ID NO: 214537 - DNA, 25 bp, E. coli
tcgaaatgacacgtcgacacggcga

SEQ ID NO: 214538 - DNA, 25 bp, E. coli
tcgaaatgacacctcgacacggcga

SEQ ID NO: 214539 - DNA, 25 bp, E. coli
tcgatgatgtcgaaatgacacgtcg

SEQ ID NO: 214540 - DNA, 25 bp, E. coli
tcgatgatgtcgtaatgacacgtcg

SEQ ID NO: 214541 - DNA, 25 bp, E. coli
gaataatgtcgatgatgtcgaaatg

SEQ ID NO: 214542 - DNA, 25 bp, E. coli
gaataatgtcgaagatgtcgaaatg

SEQ ID NO: 214543 - DNA, 25 bp, E. coli
gacacgtcgacagggcgacgaaatt

SEQ ID NO: 214544 - DNA, 25 bp, E. coli
gaaatgacacgtcgacacggcgacg

SEQ ID NO: 214545 - DNA, 25 bp, E. coli
gaaatgacacgtggacacggcgacg

SEQ ID NO: 214546 - DNA, 25 bp, E. coli
gacacgtcgacacggcgacgaaatt

SEQ ID NO: 214547 - DNA, 25 bp, E. coli
taatgtcgatgatgtcgaaatgaca

SEQ ID NO: 214548 - DNA, 25 bp, E. coli
taatgtcgatgaagtcgaaatgaca

SEQ ID NO: 214549 - DNA, 25 bp, E. coli
gatgtcgaaatgtcacgtcgacacg

SEQ ID NO: 214550 - DNA, 25 bp, E. coli
gatgtcgaaatgacacgtcgacacg

SEQ ID NO: 214551 - DNA, 25 bp, E. coli
gatgatgtcgaattgacacgtcgac

SEQ ID NO: 214552 - DNA, 25 bp, E. coli
gatgatgtcgaaatgacacgtcgac

SEQ ID NO: 214553 - DNA, 25 bp, E. coli
caccgcgtgaacagactttgcaaga

SEQ ID NO: 214554 - DNA, 25 bp, E. coli
caccgcgtgaactgactttgcaaga

SEQ ID NO: 214555 - DNA, 25 bp, E. coli
tagcaaaagtaattcgcagcaggtg

SEQ ID NO: 214556 - DNA, 25 bp, E. coli
tagcaaaagtaaatcgcagcaggtg

SEQ ID NO: 214557 - DNA, 25 bp, E. coli
tattgaaccgggtacacgggatggt

SEQ ID NO: 214558 - DNA, 25 bp, E. coli
tattgaaccgggaacacgggatggt

SEQ ID NO: 214559 - DNA, 25 bp, E. coli
tataagcaacagatacccggcgcgt

SEQ ID NO: 214560 - DNA, 25 bp, E. coli
tataagcaacagttacccggcgcgt

SEQ ID NO: 214561 - DNA, 25 bp, E. coli
ttttgggcaagtctatcaggacgct

SEQ ID NO: 214562 - DNA, 25 bp, E. coli
ttttgggcaagtgtatcaggacgct

SEQ ID NO: 214563 - DNA, 25 bp, E. coli
ttttttgcccagtacgcaccgcgtg

SEQ ID NO: 214564 - DNA, 25 bp, E. coli
ttttttgcccagaacgcaccgcgtg

SEQ ID NO: 214565 - DNA, 25 bp, E. coli
tgcaatatggcgtcgttagcccggt

SEQ ID NO: 214566 - DNA, 25 bp, E. coli
tgcaatatggcgacgttagcccggt

SEQ ID NO: 214567 - DNA, 25 bp, E. coli
cgtttactctgggtgatctgccgca

SEQ ID NO: 214568 - DNA, 25 bp, E. coli
cgatgaatcactggtgggctcggca

SEQ ID NO: 214569 - DNA, 25 bp, E. coli
cgatgaatcactcgtgggctcggca

SEQ ID NO: 214570 - DNA, 25 bp, E. coli
cgtttactctggctgatctgccgca

SEQ ID NO: 214571 - DNA, 25 bp, E. coli
gctacgtttccacgttaatgccggg

SEQ ID NO: 214572 - DNA, 25 bp, E. coli
gctacgtttccaggttaatgccggg

SEQ ID NO: 214573 - DNA, 25 bp, E. coli
gggattcaacccactcgtggcaacg

SEQ ID NO: 214574 - DNA, 25 bp, E. coli
gggattcaaccctctcgtggcaacg

SEQ ID NO: 214575 - DNA, 25 bp, E. coli
aaaaatgtgaagctgtggatccgct

SEQ ID NO: 214576 - DNA, 25 bp, E. coli
actttatgaacggttccggcggcgg

SEQ ID NO: 214577 - DNA, 25 bp, E. coli
aaaaatgtgaaggtgtggatccgct

SEQ ID NO: 214578 - DNA, 25 bp, E. coli
actttatgaacgcttccggcggcgg

SEQ ID NO: 214579 - DNA, 25 bp, E. coli
ttgttcgtgactggttccgcgcctg

SEQ ID NO: 214580 - DNA, 25 bp, E. coli
ttgttcgtgactcgttccgcgcctg

SEQ ID NO: 214581 - DNA, 25 bp, E. coli
tgaatcctgtggtaccgtagacggc

SEQ ID NO: 214582 - DNA, 25 bp, E. coli
tgaaggaagtggagacctatcgcca

SEQ ID NO: 214583 - DNA, 25 bp, E. coli
tgaatcctgtggaaccgtagacggc

SEQ ID NO: 214584 - DNA, 25 bp, E. coli
tgaaggaagtggtgacctatcgcca

SEQ ID NO: 214585 - DNA, 25 bp, E. coli
gcctgatgcgctgcctgtattgtca

SEQ ID NO: 214586 - DNA, 25 bp, E. coli
gcctgatgcgctccctgtattgtca

SEQ ID NO: 214587 - DNA, 25 bp, E. coli
gaactgctggaagtaaccgacctgg

SEQ ID NO: 214588 - DNA, 25 bp, E. coli
gaactgctggaactaaccgacctgg

SEQ ID NO: 214589 - DNA, 25 bp, E. coli
cccaggctggtctgacgatgacgat

SEQ ID NO: 214590 - DNA, 25 bp, E. coli
ccgacctggtaatgctcgatctcaa

SEQ ID NO: 214591 - DNA, 25 bp, E. coli
cccaggctggtcagacgatgacgat

SEQ ID NO: 214592 - DNA, 25 bp, E. coli
ccgacctggtaaagctcgatctcaa

SEQ ID NO: 214593 - DNA, 25 bp, E. coli
gtattgtcataaccgcgacacctgg

SEQ ID NO: 214594 - DNA, 25 bp, E. coli
gtattgtcataagcgcgacacctgg

SEQ ID NO: 214595 - DNA, 25 bp, E. coli
tcaaacagatgatcgacgagatcca

SEQ ID NO: 214596 - DNA, 25 bp, E. coli
tcaaacagatgaacgacgagatcca

SEQ ID NO: 214597 - DNA, 25 bp, E. coli
aatgcgccgaagatccttacccgtg

SEQ ID NO: 214598 - DNA, 25 bp, E. coli
aatgcgccgaagttccttacccgtg

SEQ ID NO: 214599 - DNA, 25 bp, E. coli
atgcgccgaagttccttacccgtgt

SEQ ID NO: 214600 - DNA, 25 bp, E. coli
atgcgccgaagtaccttacccgtgt

SEQ ID NO: 214601 - DNA, 25 bp, E. coli
tacccgtgttaggcgtcgcggcgtg

SEQ ID NO: 214602 - DNA, 25 bp, E. coli
tacccgtgttagccgtcgcggcgtg

SEQ ID NO: 214603 - DNA, 25 bp, E. coli
ttacccgtgttagccgtcgcggcgt

SEQ ID NO: 214604 - DNA, 25 bp, E. coli
ttacccgtgttacccgtcgcggcgt

SEQ ID NO: 214605 - DNA, 25 bp, E. coli
ttcgccgggttcctctccggctgga

SEQ ID NO: 214606 - DNA, 25 bp, E. coli
ttcgccgggttcgtctccggctgga

SEQ ID NO: 214607 - DNA, 25 bp, E. coli
tcgccgggttccactccggctggaa

SEQ ID NO: 214608 - DNA, 25 bp, E. coli
tcgccgggttcctctccggctggaa

SEQ ID NO: 214609 - DNA, 25 bp, E. coli
tgcgccgaagttccttacccgtgtt

SEQ ID NO: 214610 - DNA, 25 bp, E. coli
tccttacccgtgatagccgtcgcgg

SEQ ID NO: 214611 - DNA, 25 bp, E. coli
tccttacccgtgttagccgtcgcgg

SEQ ID NO: 214612 - DNA, 25 bp, E. coli
tgcgccgaagttgcttacccgtgtt

SEQ ID NO: 214613 - DNA, 25 bp, E. coli
cttacccgtgttagccgtcgcggcg

SEQ ID NO: 214614 - DNA, 25 bp, E. coli
gccgggttcctctccggctggaact

SEQ ID NO: 214615 - DNA, 25 bp, E. coli
cttacccgtgtttgccgtcgcggcg

SEQ ID NO: 214616 - DNA, 25 bp, E. coli
gccgggttcctcaccggctggaact

SEQ ID NO: 214617 - DNA, 25 bp, E. coli
taatgcgccgaagttccttacccgt

SEQ ID NO: 214618 - DNA, 25 bp, E. coli
taatgcgccgaacttccttacccgt

SEQ ID NO: 214619 - DNA, 25 bp, E. coli
aagcagattaaacaactccagcgcc

SEQ ID NO: 214620 - DNA, 25 bp, E. coli
aagcagattaaagaactccagcgcc

SEQ ID NO: 214621 - DNA, 25 bp, E. coli
catgaagcagataaaagaactccag

SEQ ID NO: 214622 - DNA, 25 bp, E. coli
catgaagcagattaaagaactccag

SEQ ID NO: 214623 - DNA, 25 bp, E. coli
agcagattaaagtactccagcgcct

SEQ ID NO: 214624 - DNA, 25 bp, E. coli
atgaagcagatttaagaactccagc

SEQ ID NO: 214625 - DNA, 25 bp, E. coli
atgaagcagattaaagaactccagc

SEQ ID NO: 214626 - DNA, 25 bp, E. coli
agcagattaaagaactccagcgcct

SEQ ID NO: 214627 - DNA, 25 bp, E. coli
tgaagcagattaaagaactccagcg

SEQ ID NO: 214628 - DNA, 25 bp, E. coli
tgaagcagattatagaactccagcg

SEQ ID NO: 214629 - DNA, 25 bp, E. coli
ccatgaagcagaataaagaactcca

SEQ ID NO: 214630 - DNA, 25 bp, E. coli
ccatgaagcagattaaagaactcca

SEQ ID NO: 214631 - DNA, 25 bp, E. coli
gccatgaagcagattaaagaactcc

SEQ ID NO: 214632 - DNA, 25 bp, E. coli
gccatgaagcagtttaaagaactcc

SEQ ID NO: 214633 - DNA, 25 bp, E. coli
gcagattaaagatctccagcgcctg

SEQ ID NO: 214634 - DNA, 25 bp, E. coli
gaagcagattaaagaactccagcgc

SEQ ID NO: 214635 - DNA, 25 bp, E. coli
gcagattaaagaactccagcgcctg

SEQ ID NO: 214636 - DNA, 25 bp, E. coli
gaagcagattaatgaactccagcgc

SEQ ID NO: 214637 - DNA, 25 bp, E. coli
agcaccgaccgtaagcccgttatgt

SEQ ID NO: 214638 - DNA, 25 bp, E. coli
agcccgttatgttattgtttcatta

SEQ ID NO: 214639 - DNA, 25 bp, E. coli
agcaccgaccgttagcccgttatgt

SEQ ID NO: 214640 - DNA, 25 bp, E. coli
agcccgttatgtaattgtttcatta

SEQ ID NO: 214641 - DNA, 25 bp, E. coli
aagcccgttatgatattgtttcatt

SEQ ID NO: 214642 - DNA, 25 bp, E. coli
aagcccgttatgttattgtttcatt

SEQ ID NO: 214643 - DNA, 25 bp, E. coli
tgagcaccgaccgtaagcccgttat

SEQ ID NO: 214644 - DNA, 25 bp, E. coli
tgagcaccgaccctaagcccgttat

SEQ ID NO: 214645 - DNA, 25 bp, E. coli
gcaccgaccgtaagcccgttatgtt

SEQ ID NO: 214646 - DNA, 25 bp, E. coli
gcccgttatgttattgtttcattag

SEQ ID NO: 214647 - DNA, 25 bp, E. coli
gcccgttatgtttttgtttcattag

SEQ ID NO: 214648 - DNA, 25 bp, E. coli
gcaccgaccgtatgcccgttatgtt

SEQ ID NO: 214649 - DNA, 25 bp, E. coli
gtaagcccgttatgttattgtttca

SEQ ID NO: 214650 - DNA, 25 bp, E. coli
gtaagcccgttaagttattgtttca

SEQ ID NO: 214651 - DNA, 25 bp, E. coli
gaccgtaagccccttatgttattgt

SEQ ID NO: 214652 - DNA, 25 bp, E. coli
gaccgtaagcccgttatgttattgt

SEQ ID NO: 214653 - DNA, 25 bp, E. coli
cgaccgtaagccggttatgttattg

SEQ ID NO: 214654 - DNA, 25 bp, E. coli
cgaccgtaagcccgttatgttattg

SEQ ID NO: 214655 - DNA, 25 bp, E. coli
taagcccgttatgttattgtttcat

SEQ ID NO: 214656 - DNA, 25 bp, E. coli
taagcccgttatcttattgtttcat

SEQ ID NO: 214657 - DNA, 25 bp, E. coli
gagcaccgaccgtaagcccgttatg

SEQ ID NO: 214658 - DNA, 25 bp, E. coli
gagcaccgaccgaaagcccgttatg

SEQ ID NO: 214659 - DNA, 25 bp, E. coli
aacggtctgctgacatccatttcgg

SEQ ID NO: 214660 - DNA, 25 bp, E. coli
taaaatccgtctgattgtccaggcg

SEQ ID NO: 214661 - DNA, 25 bp, E. coli
taaaatccgtctcattgtccaggcg

SEQ ID NO: 214662 - DNA, 25 bp, E. coli
atggccctgaaaagctacccgctgc

SEQ ID NO: 214663 - DNA, 25 bp, E. coli
atggccctgaaatgctacccgctgc

SEQ ID NO: 214664 - DNA, 25 bp, E. coli
aacggtctgctgtcatccatttcgg

SEQ ID NO: 214665 - DNA, 25 bp, E. coli
tttggctacggtgaaacgctgccgg

SEQ ID NO: 214666 - DNA, 25 bp, E. coli
tttggctacggtcaaacgctgccgg

SEQ ID NO: 214667 - DNA, 25 bp, E. coli
tgatcatcgctaaagcggctggctg

SEQ ID NO: 214668 - DNA, 25 bp, E. coli
tgatcatcgctatagcggctggctg

SEQ ID NO: 214669 - DNA, 25 bp, E. coli
tccgtgaagaggtggcggcaaatct

SEQ ID NO: 214670 - DNA, 25 bp, E. coli
tccgtgaagaggaggcggcaaatct

SEQ ID NO: 214671 - DNA, 25 bp, E. coli
gaaagtggcgctatcacgttgaagc

SEQ ID NO: 214672 - DNA, 25 bp, E. coli
gaaagtggcgctttcacgttgaagc

SEQ ID NO: 214673 - DNA, 25 bp, E. coli
gaacagttccgtggctttctgcgta

SEQ ID NO: 214674 - DNA, 25 bp, E. coli
gaacagttccgtcgctttctgcgta

SEQ ID NO: 214675 - DNA, 25 bp, E. coli
ccgaatggtttaagcaaatgggctg

SEQ ID NO: 214676 - DNA, 25 bp, E. coli
ccgaatggtttatgcaaatgggctg

SEQ ID NO: 214677 - DNA, 25 bp, E. coli
tcaacgaagcgatagcggcaatgga

SEQ ID NO: 214678 - DNA, 25 bp, E. coli
tcaacgaagcgaaagcggcaatgga

SEQ ID NO: 214679 - DNA, 25 bp, E. coli
taacctgcctgcaggtagagaagct

SEQ ID NO: 214680 - DNA, 25 bp, E. coli
taacctgcctgctggtagagaagct

SEQ ID NO: 214681 - DNA, 25 bp, E. coli
cactgcacggcatcagtgaagatga

SEQ ID NO: 214682 - DNA, 25 bp, E. coli
cactgcacggcaacagtgaagatga

SEQ ID NO: 214683 - DNA, 25 bp, E. coli
catgggcctgatgccagggcacgtt

SEQ ID NO: 214684 - DNA, 25 bp, E. coli
catgggcctgatcccagggcacgtt

SEQ ID NO: 214685 - DNA, 25 bp, E. coli
tttttaaaaatgttgctgcgccgga

SEQ ID NO: 214686 - DNA, 25 bp, E. coli
ttgaaagatggaatgttggcgatcg

SEQ ID NO: 214687 - DNA, 25 bp, E. coli
tttttaaaaatgatgctgcgccgga

SEQ ID NO: 214688 - DNA, 25 bp, E. coli
ttgaaagatggattgttggcgatcg

SEQ ID NO: 214689 - DNA, 25 bp, E. coli
tgatgccagggctcgtttatcgcgc

SEQ ID NO: 214690 - DNA, 25 bp, E. coli
tgatgccagggcacgtttatcgcgc

SEQ ID NO: 214691 - DNA, 25 bp, E. coli
tcgccagtatcctccgaatttttaa

SEQ ID NO: 214692 - DNA, 25 bp, E. coli
tcgccagtatccaccgaatttttaa

SEQ ID NO: 214693 - DNA, 25 bp, E. coli
tcagtgaagatgatgctatcgccag

SEQ ID NO: 214694 - DNA, 25 bp, E. coli
gccagggcacgtttatcgcgcgctt

SEQ ID NO: 214695 - DNA, 25 bp, E. coli
gccagggcacgtatatcgcgcgctt

SEQ ID NO: 214696 - DNA, 25 bp, E. coli
gaagatgatgctttcgccagtatcc

SEQ ID NO: 214697 - DNA, 25 bp, E. coli
gaagatgatgctatcgccagtatcc

SEQ ID NO: 214698 - DNA, 25 bp, E. coli
cttgcccactgctcggcatcagtga

SEQ ID NO: 214699 - DNA, 25 bp, E. coli
cttgcccactgcacggcatcagtga

SEQ ID NO: 214700 - DNA, 25 bp, E. coli
tcagtgaagatgttgctatcgccag

SEQ ID NO: 214701 - DNA, 25 bp, E. coli
gatgctatcgccagtatccaccgaa

SEQ ID NO: 214702 - DNA, 25 bp, E. coli
gatgctatcgcctgtatccaccgaa

SEQ ID NO: 214703 - DNA, 25 bp, E. coli
taaatattcctacagcagtcggtgg

SEQ ID NO: 214704 - DNA, 25 bp, E. coli
taaatattcctagagcagtcggtgg

SEQ ID NO: 214705 - DNA, 25 bp, E. coli
aaaaagcagctcaccaagatatgag

SEQ ID NO: 214706 - DNA, 25 bp, E. coli
aaaaagcagctctccaagatatgag

SEQ ID NO: 214707 - DNA, 25 bp, E. coli
tatgtcagcaatcataaaaagcagc

SEQ ID NO: 214708 - DNA, 25 bp, E. coli
tatgtcagcaatgataaaaagcagc

SEQ ID NO: 214709 - DNA, 25 bp, E. coli
tggtgtatcatctggctcgggacga

SEQ ID NO: 214710 - DNA, 25 bp, E. coli
tggtgtatcatcaggctcgggacga

SEQ ID NO: 214711 - DNA, 25 bp, E. coli
tgatttcaaaaatgacgatggctct

SEQ ID NO: 214712 - DNA, 25 bp, E. coli
tgatttcaaaaaagacgatggctct

SEQ ID NO: 214713 - DNA, 25 bp, E. coli
tgagctagctaagactgatgaatgg

SEQ ID NO: 214714 - DNA, 25 bp, E. coli
tgagctagctaacactgatgaatgg

SEQ ID NO: 214715 - DNA, 25 bp, E. coli
gaattgattcaaaaacaccccgact

SEQ ID NO: 214716 - DNA, 25 bp, E. coli
gaattgattcaataacaccccgact

SEQ ID NO: 214717 - DNA, 25 bp, E. coli
cccgactcagatcctttcagaaaaa

SEQ ID NO: 214718 - DNA, 25 bp, E. coli
cccgactcagatgctttcagaaaaa

SEQ ID NO: 214719 - DNA, 25 bp, E. coli
ggctcgggacgatgaaataaaactg

SEQ ID NO: 214720 - DNA, 25 bp, E. coli
ggctcgggacgaagaaataaaactg

SEQ ID NO: 214721 - DNA, 25 bp, E. coli
taaaagatcttgaagcaacctccaa

SEQ ID NO: 214722 - DNA, 25 bp, E. coli
taaaagatcttgtagcaacctccaa

SEQ ID NO: 214723 - DNA, 25 bp, E. coli
gatggctctagttcgaaaatggcag

SEQ ID NO: 214724 - DNA, 25 bp, E. coli
gatggctctagtacgaaaatggcag

SEQ ID NO: 214725 - DNA, 25 bp, E. coli
tactgctgccgtgagaaaagatggt

SEQ ID NO: 214726 - DNA, 25 bp, E. coli
tacagctattgttgtcaccgatcca

SEQ ID NO: 214727 - DNA, 25 bp, E. coli
taaaatttgatgctgcgacagcaac

SEQ ID NO: 214728 - DNA, 25 bp, E. coli
tactgctgccgtcagaaaagatggt

SEQ ID NO: 214729 - DNA, 25 bp, E. coli
tacagctattgtagtcaccgatcca

SEQ ID NO: 214730 - DNA, 25 bp, E. coli
taaaatttgatggtgcgacagcaac

SEQ ID NO: 214731 - DNA, 25 bp, E. coli
tatgctgctccatctattcctcagg

SEQ ID NO: 214732 - DNA, 25 bp, E. coli
tatgctgctccaactattcctcagg

SEQ ID NO: 214733 - DNA, 25 bp, E. coli
tttcgggtgtcccaagtggtccgca

SEQ ID NO: 214734 - DNA, 25 bp, E. coli
tttcgggtgtccgaagtggtccgca

SEQ ID NO: 214735 - DNA, 25 bp, E. coli
tgcaccatgtggaattgatgctcag

SEQ ID NO: 214736 - DNA, 25 bp, E. coli
tgcaccatgtggtattgatgctcag

SEQ ID NO: 214737 - DNA, 25 bp, E. coli
tccgcagagtgagatgttacagacc

SEQ ID NO: 214738 - DNA, 25 bp, E. coli
tccgcagagtgacatgttacagacc

SEQ ID NO: 214739 - DNA, 25 bp, E. coli
taacggaactgtagtagatgcacca

SEQ ID NO: 214740 - DNA, 25 bp, E. coli
taacggaactgttgtagatgcacca

SEQ ID NO: 214741 - DNA, 25 bp, E. coli
gaccgtcggtgcaacaaatacagct

SEQ ID NO: 214742 - DNA, 25 bp, E. coli
gatggtagtggcaaccctgtaacag

SEQ ID NO: 214743 - DNA, 25 bp, E. coli
gatccacatggataacgcgtaaaat

SEQ ID NO: 214744 - DNA, 25 bp, E. coli
gatggtagtggctaccctgtaacag

SEQ ID NO: 214745 - DNA, 25 bp, E. coli
gatccacatggaaaacgcgtaaaat

SEQ ID NO: 214746 - DNA, 25 bp, E. coli
gaccgtcggtgctacaaatacagct

SEQ ID NO: 214747 - DNA, 25 bp, E. coli
aatatttacaacatagcaatcaacc

SEQ ID NO: 214748 - DNA, 25 bp, E. coli
aatatttacaacttagcaatcaacc

SEQ ID NO: 214749 - DNA, 25 bp, E. coli
tataaatgcgactaccatgaagttt

SEQ ID NO: 214750 - DNA, 25 bp, E. coli
tataaatgcgacaaccatgaagttt

SEQ ID NO: 214751 - DNA, 25 bp, E. coli
agtcctttaaggatatagaataggg

SEQ ID NO: 214752 - DNA, 25 bp, E. coli
agtcctttaaggttatagaataggg

SEQ ID NO: 214753 - DNA, 25 bp, E. coli
aaatcaacccgcgatatgaacggcg

SEQ ID NO: 214754 - DNA, 25 bp, E. coli
aaatcaacccgccatatgaacggcg

SEQ ID NO: 214755 - DNA, 25 bp, E. coli
tagatagacgtcattttcatagggt

SEQ ID NO: 214756 - DNA, 25 bp, E. coli
tagctacgccagaatatcgtatttg

SEQ ID NO: 214757 - DNA, 25 bp, E. coli
tagatagacgtctttttcatagggt

SEQ ID NO: 214758 - DNA, 25 bp, E. coli
tagctacgccagtatatcgtatttg

SEQ ID NO: 214759 - DNA, 25 bp, E. coli
tttaggcatatataaatcaacccgc

SEQ ID NO: 214760 - DNA, 25 bp, E. coli
tttaggcatataaaaatcaacccgc

SEQ ID NO: 214761 - DNA, 25 bp, E. coli
tcatagggttataaatgcgactacc

SEQ ID NO: 214762 - DNA, 25 bp, E. coli
tcatagggttattaatgcgactacc

SEQ ID NO: 214763 - DNA, 25 bp, E. coli
gcaaaactaaataattggtatcatg

SEQ ID NO: 214764 - DNA, 25 bp, E. coli
gcaaaactaaattattggtatcatg

SEQ ID NO: 214765 - DNA, 25 bp, E. coli
gggttgctgataatttgagctgttc

SEQ ID NO: 214766 - DNA, 25 bp, E. coli
gggttgctgatattttgagctgttc

SEQ ID NO: 214767 - DNA, 25 bp, E. coli
taattgaaagtattgggttgctgat

SEQ ID NO: 214768 - DNA, 25 bp, E. coli
taattgaaagtaatgggttgctgat

SEQ ID NO: 214769 - DNA, 25 bp, E. coli
caatctggactgttatcatgaaacg

SEQ ID NO: 214770 - DNA, 25 bp, E. coli
caatctggactgatatcatgaaacg

SEQ ID NO: 214771 - DNA, 25 bp, E. coli
caaaatgtacgcgacgaacttcgcc

SEQ ID NO: 214772 - DNA, 25 bp, E. coli
caaacatatctacagcgatgtcgat

SEQ ID NO: 214773 - DNA, 25 bp, E. coli
caaacatatctagagcgatgtcgat

SEQ ID NO: 214774 - DNA, 25 bp, E. coli
caaaatgtacgccacgaacttcgcc

SEQ ID NO: 214775 - DNA, 25 bp, E. coli
tgatgtcggttatcccagcgtaaac

SEQ ID NO: 214776 - DNA, 25 bp, E. coli
tgatgtcggttaacccagcgtaaac

SEQ ID NO: 214777 - DNA, 25 bp, E. coli
tccgcaatacccgaataaagcggtc

SEQ ID NO: 214778 - DNA, 25 bp, E. coli
tccgcaataccccaataaagcggtc

SEQ ID NO: 214779 - DNA, 25 bp, E. coli
gcccggcagcaatcatatctacagc

SEQ ID NO: 214780 - DNA, 25 bp, E. coli
gcccggcagcaaacatatctacagc

SEQ ID NO: 214781 - DNA, 25 bp, E. coli
gactgatatcatcaaacggacaatg

SEQ ID NO: 214782 - DNA, 25 bp, E. coli
gactgatatcatgaaacggacaatg

SEQ ID NO: 214783 - DNA, 25 bp, E. coli
gattagccagcaagttgatgtcggt

SEQ ID NO: 214784 - DNA, 25 bp, E. coli
gattagccagcatgttgatgtcggt

SEQ ID NO: 214785 - DNA, 25 bp, E. coli
tggcagcgtgttgatggaacagcct

SEQ ID NO: 214786 - DNA, 25 bp, E. coli
ggcagatccgcaatacccgaataaa

SEQ ID NO: 214787 - DNA, 25 bp, E. coli
tggcagcgtgttcatggaacagcct

SEQ ID NO: 214788 - DNA, 25 bp, E. coli
ggcagatccgcattacccgaataaa

SEQ ID NO: 214789 - DNA, 25 bp, E. coli
gatggaacagccagtcaaagccacc

SEQ ID NO: 214790 - DNA, 25 bp, E. coli
gatggaacagcctgtcaaagccacc

SEQ ID NO: 214791 - DNA, 25 bp, E. coli
aattattgcccctcaatctatgccg

SEQ ID NO: 214792 - DNA, 25 bp, E. coli
aattattgccccacaatctatgccg

SEQ ID NO: 214793 - DNA, 25 bp, E. coli
cacgattatgtgtttgcctccgcaa

SEQ ID NO: 214794 - DNA, 25 bp, E. coli
cacgattatgtgattgcctccgcaa

SEQ ID NO: 214795 - DNA, 25 bp, E. coli
taaatgcgagagagcgacatgccag

SEQ ID NO: 214796 - DNA, 25 bp, E. coli
tacagataattcgattgtcaggttc

SEQ ID NO: 214797 - DNA, 25 bp, E. coli
taaatgcgagagtgcgacatgccag

SEQ ID NO: 214798 - DNA, 25 bp, E. coli
tacagataattccattgtcaggttc

SEQ ID NO: 214799 - DNA, 25 bp, E. coli
aaatttcgcgatccaataaacgggc

SEQ ID NO: 214800 - DNA, 25 bp, E. coli
aaatttcgcgatgcaataaacgggc

SEQ ID NO: 214801 - DNA, 25 bp, E. coli
tgcgactgagttgaaattattgccc

SEQ ID NO: 214802 - DNA, 25 bp, E. coli
tgcgactgagttcaaattattgccc

SEQ ID NO: 214803 - DNA, 25 bp, E. coli
tcaggttctcttctcattttcgtgg

SEQ ID NO: 214804 - DNA, 25 bp, E. coli
tcaggttctcttgtcattttcgtgg

SEQ ID NO: 214805 - DNA, 25 bp, E. coli
cgggcatatatttggtagcatgacc

SEQ ID NO: 214806 - DNA, 25 bp, E. coli
cgggcatatattaggtagcatgacc

SEQ ID NO: 214807 - DNA, 25 bp, E. coli
tcaacattgccgttcaaaagagcgc

SEQ ID NO: 214808 - DNA, 25 bp, E. coli
tcaaaagagcgcaatccagataaaa

SEQ ID NO: 214809 - DNA, 25 bp, E. coli
tcaacattgccgatcaaaagagcgc

SEQ ID NO: 214810 - DNA, 25 bp, E. coli
tcaaaagagcgctatccagataaaa

SEQ ID NO: 214811 - DNA, 25 bp, E. coli
gagttatgtcttgtcaaatttcgcg

SEQ ID NO: 214812 - DNA, 25 bp, E. coli
gagttatgtcttctcaaatttcgcg

SEQ ID NO: 214813 - DNA, 25 bp, E. coli
aatattgtgagttaatacgcaagcg

SEQ ID NO: 214814 - DNA, 25 bp, E. coli
aatattgtgagtaaatacgcaagcg

SEQ ID NO: 214815 - DNA, 25 bp, E. coli
tacgctgcggcaaacttactggtga

SEQ ID NO: 214816 - DNA, 25 bp, E. coli
tacgcaagcggtacgcggaaatcgc

SEQ ID NO: 214817 - DNA, 25 bp, E. coli
aaatcgccagcgcagacttaggata

SEQ ID NO: 214818 - DNA, 25 bp, E. coli
aaatcgccagcggagacttaggata

SEQ ID NO: 214819 - DNA, 25 bp, E. coli
acttactggtgaccgattatgtcaa

SEQ ID NO: 214820 - DNA, 25 bp, E. coli
acttactggtgagcgattatgtcaa

SEQ ID NO: 214821 - DNA, 25 bp, E. coli
tacgcaagcggttcgcggaaatcgc

SEQ ID NO: 214822 - DNA, 25 bp, E. coli
tacgctgcggcatacttactggtga

SEQ ID NO: 214823 - DNA, 25 bp, E. coli
ttccggacgcgcagggctgcgtttt

SEQ ID NO: 214824 - DNA, 25 bp, E. coli
ttccggacgcgctgggctgcgtttt

SEQ ID NO: 214825 - DNA, 25 bp, E. coli
tgtcagggaaaatgcagcatacgct

SEQ ID NO: 214826 - DNA, 25 bp, E. coli
tgtcagggaaaaagcagcatacgct

SEQ ID NO: 214827 - DNA, 25 bp, E. coli
tgctgaatgaaatggctgccgacga

SEQ ID NO: 214828 - DNA, 25 bp, E. coli
tgctgaatgaaaaggctgccgacga

SEQ ID NO: 214829 - DNA, 25 bp, E. coli
gctgcgttttgaaagtgctgaatga

SEQ ID NO: 214830 - DNA, 25 bp, E. coli
gctgcgttttgatagtgctgaatga

SEQ ID NO: 214831 - DNA, 25 bp, E. coli
gacttaggataccttccggacgcgc

SEQ ID NO: 214832 - DNA, 25 bp, E. coli
gacttaggatacgttccggacgcgc

SEQ ID NO: 214833 - DNA, 25 bp, E. coli
ccctttctgaggctgtcagggaaaa

SEQ ID NO: 214834 - DNA, 25 bp, E. coli
ccctttctgagggtgtcagggaaaa

SEQ ID NO: 214835 - DNA, 25 bp, E. coli
taaagaaaatctcgagcgggctatc

SEQ ID NO: 214836 - DNA, 25 bp, E. coli
taaagaaaatctggagcgggctatc

SEQ ID NO: 214837 - DNA, 25 bp, E. coli
agtatttgcttaacccctgacggag

SEQ ID NO: 214838 - DNA, 25 bp, E. coli
agtatttgcttatcccctgacggag

SEQ ID NO: 214839 - DNA, 25 bp, E. coli
aaaaatccggcaaacccggctcagg

SEQ ID NO: 214840 - DNA, 25 bp, E. coli
aaaaatccggcatacccggctcagg

SEQ ID NO: 214841 - DNA, 25 bp, E. coli
tagagtaaatgagaaaatccagagt

SEQ ID NO: 214842 - DNA, 25 bp, E. coli
tagagtaaatgacaaaatccagagt

SEQ ID NO: 214843 - DNA, 25 bp, E. coli
ttgagcgagtattgaataaacacct

SEQ ID NO: 214844 - DNA, 25 bp, E. coli
ttgagcgagtatagaataaacacct

SEQ ID NO: 214845 - DNA, 25 bp, E. coli
tgaaaacatttgtactcgccaacaa

SEQ ID NO: 214846 - DNA, 25 bp, E. coli
tgaaaacatttgaactcgccaacaa

SEQ ID NO: 214847 - DNA, 25 bp, E. coli
tgagttttcttttgccgtgtggtgg

SEQ ID NO: 214848 - DNA, 25 bp, E. coli
tgagttttctttagccgtgtggtgg

SEQ ID NO: 214849 - DNA, 25 bp, E. coli
cccggctcaggacagtctgttaata

SEQ ID NO: 214850 - DNA, 25 bp, E. coli
cccggctcaggagagtctgttaata

SEQ ID NO: 214851 - DNA, 25 bp, E. coli
cgatcgtcgaaggaaaagtatttgc

SEQ ID NO: 214852 - DNA, 25 bp, E. coli
cgatcgtcgaagcaaaagtatttgc

SEQ ID NO: 214853 - DNA, 25 bp, E. coli
gatgattattgtgagtccccttctg

SEQ ID NO: 214854 - DNA, 25 bp, E. coli
gacggagttacagttgctcaaaaac

SEQ ID NO: 214855 - DNA, 25 bp, E. coli
gatgattattgtcagtccccttctg

SEQ ID NO: 214856 - DNA, 25 bp, E. coli
gacggagttacacttgctcaaaaac

SEQ ID NO: 214857 - DNA, 25 bp, E. coli
cagaagtggtgctctaccttgagac

SEQ ID NO: 214858 - DNA, 25 bp, E. coli
cagaagtggtgcactaccttgagac

SEQ ID NO: 214859 - DNA, 25 bp, E. coli
taaaaatctaccttaacccacgctg

SEQ ID NO: 214860 - DNA, 25 bp, E. coli
taaaaatctaccataacccacgctg

SEQ ID NO: 214861 - DNA, 25 bp, E. coli
aagaaaacggcgtggagccagaagt

SEQ ID NO: 214862 - DNA, 25 bp, E. coli
aagaaaacggcgaggagccagaagt

SEQ ID NO: 214863 - DNA, 25 bp, E. coli
aaagagccgggaaacgctgaacctg

SEQ ID NO: 214864 - DNA, 25 bp, E. coli
aaagagccgggatacgctgaacctg

SEQ ID NO: 214865 - DNA, 25 bp, E. coli
ttataaagaactgaacctggctgac

SEQ ID NO: 214866 - DNA, 25 bp, E. coli
ttataaagaactcaacctggctgac

SEQ ID NO: 214867 - DNA, 25 bp, E. coli
tcgtccaccggagcaggtactggaa

SEQ ID NO: 214868 - DNA, 25 bp, E. coli
tcgtccaccggaccaggtactggaa

SEQ ID NO: 214869 - DNA, 25 bp, E. coli
cctggctgacagatcgcttagcgaa

SEQ ID NO: 214870 - DNA, 25 bp, E. coli
cctggctgacagttcgcttagcgaa

SEQ ID NO: 214871 - DNA, 25 bp, E. coli
gctgaacctgctgaaagaaaacggc

SEQ ID NO: 214872 - DNA, 25 bp, E. coli
gctgaacctgctcaaagaaaacggc

SEQ ID NO: 214873 - DNA, 25 bp, E. coli
cccgattgtggtggcgaatggcaaa

SEQ ID NO: 214874 - DNA, 25 bp, E. coli
cccgattgtggtcgcgaatggcaaa

SEQ ID NO: 214875 - DNA, 25 bp, E. coli
ggcaaagcgcggattggtcgtccac

SEQ ID NO: 214876 - DNA, 25 bp, E. coli
ggcaaagcgcggtttggtcgtccac

SEQ ID NO: 214877 - DNA, 25 bp, E. coli
taacccacgctgatcaaagagccgg

SEQ ID NO: 214878 - DNA, 25 bp, E. coli
taacccacgctgttcaaagagccgg

SEQ ID NO: 214879 - DNA, 25 bp, E. coli
aacccatcaaacaggggcgcagcag

SEQ ID NO: 214880 - DNA, 25 bp, E. coli
ctaaacccatcatactggggcgcag

SEQ ID NO: 214881 - DNA, 25 bp, E. coli
catttccctaaacccatcaaactgg

SEQ ID NO: 214882 - DNA, 25 bp, E. coli
catttccctaaagccatcaaactgg

SEQ ID NO: 214883 - DNA, 25 bp, E. coli
ctaaacccatcaaactggggcgcag

SEQ ID NO: 214884 - DNA, 25 bp, E. coli
taaacccatcaaactggggcgcagc

SEQ ID NO: 214885 - DNA, 25 bp, E. coli
taaacccatcaatctggggcgcagc

SEQ ID NO: 214886 - DNA, 25 bp, E. coli
acccatcaaactggggcgcagcagc

SEQ ID NO: 214887 - DNA, 25 bp, E. coli
tccctaaacccaacaaactggggcg

SEQ ID NO: 214888 - DNA, 25 bp, E. coli
atcaaactggggggcagcagccgct

SEQ ID NO: 214889 - DNA, 25 bp, E. coli
atcaaactggggcgcagcagccgct

SEQ ID NO: 214890 - DNA, 25 bp, E. coli
tccctaaacccatcaaactggggcg

SEQ ID NO: 214891 - DNA, 25 bp, E. coli
aaacccatcaaactggggcgcagca

SEQ ID NO: 214892 - DNA, 25 bp, E. coli
acccatcaaactcgggcgcagcagc

SEQ ID NO: 214893 - DNA, 25 bp, E. coli
aaacccatcaaagtggggcgcagca

SEQ ID NO: 214894 - DNA, 25 bp, E. coli
aacccatcaaactggggcgcagcag

SEQ ID NO: 214895 - DNA, 25 bp, E. coli
cctaaacccatctaactggggcgca

SEQ ID NO: 214896 - DNA, 25 bp, E. coli
cctaaacccatcaaactggggcgca

SEQ ID NO: 214897 - DNA, 25 bp, E. coli
ggcgcagcagcccctggtacaaaag

SEQ ID NO: 214898 - DNA, 25 bp, E. coli
ggcgcagcagccgctggtacaaaag

SEQ ID NO: 214899 - DNA, 25 bp, E. coli
tcaaactggggcccagcagccgctg

SEQ ID NO: 214900 - DNA, 25 bp, E. coli
tcaaactggggcgcagcagccgctg

SEQ ID NO: 214901 - DNA, 25 bp, E. coli
aattcacttatcaggcaccgcaaaa

SEQ ID NO: 214902 - DNA, 25 bp, E. coli
aattcacttatctggcaccgcaaaa

SEQ ID NO: 214903 - DNA, 25 bp, E. coli
tcggtgaaaccaggcgttgggacca

SEQ ID NO: 214904 - DNA, 25 bp, E. coli
tcatcggtgaaagcacgcgttggga

SEQ ID NO: 214905 - DNA, 25 bp, E. coli
tcatcggtgaaaccacgcgttggga

SEQ ID NO: 214906 - DNA, 25 bp, E. coli
tcggtgaaaccacgcgttgggacca

SEQ ID NO: 214907 - DNA, 25 bp, E. coli
tcggctatgagcgtaataccacgcc

SEQ ID NO: 214908 - DNA, 25 bp, E. coli
tcggctatgagcctaataccacgcc

SEQ ID NO: 214909 - DNA, 25 bp, E. coli
gctatgagcgtaataccacgccgaa

SEQ ID NO: 214910 - DNA, 25 bp, E. coli
gctatgagcgtattaccacgccgaa

SEQ ID NO: 214911 - DNA, 25 bp, E. coli
gaatcttccgattataattcattgc

SEQ ID NO: 214912 - DNA, 25 bp, E. coli
gaatcttccgataataattcattgc

SEQ ID NO: 214913 - DNA, 25 bp, E. coli
gaaattcacttatcaggcaccgcaa

SEQ ID NO: 214914 - DNA, 25 bp, E. coli
gaaattcacttaacaggcaccgcaa

SEQ ID NO: 214915 - DNA, 25 bp, E. coli
cggcgaagaaattcacttatcaggc

SEQ ID NO: 214916 - DNA, 25 bp, E. coli
cttatgtcgtgtttatcatcggtga

SEQ ID NO: 214917 - DNA, 25 bp, E. coli
cttatgtcgtgtatatcatcggtga

SEQ ID NO: 214918 - DNA, 25 bp, E. coli
cggcgaagaaatacacttatcaggc

SEQ ID NO: 214919 - DNA, 25 bp, E. coli
tcaaactggctttctgcgttggggc

SEQ ID NO: 214920 - DNA, 25 bp, E. coli
tcaaactggcttactgcgttggggc

SEQ ID NO: 214921 - DNA, 25 bp, E. coli
gagcagttccgcgtaccgatgatgg

SEQ ID NO: 214922 - DNA, 25 bp, E. coli
gagcagttccgcctaccgatgatgg

SEQ ID NO: 214923 - DNA, 25 bp, E. coli
aggcgaaccggatctcaacgtcgag

SEQ ID NO: 214924 - DNA, 25 bp, E. coli
aggcgaaccggaactcaacgtcgag

SEQ ID NO: 214925 - DNA, 25 bp, E. coli
acgtcgattgcaggcgcgactggaa

SEQ ID NO: 214926 - DNA, 25 bp, E. coli
aacgtcgagctgctgaaaaaagtgg

SEQ ID NO: 214927 - DNA, 25 bp, E. coli
acgtcgattgcacgcgcgactggaa

SEQ ID NO: 214928 - DNA, 25 bp, E. coli
aacgtcgagctggtgaaaaaagtgg

SEQ ID NO: 214929 - DNA, 25 bp, E. coli
ttggacgtcgattgcaggcgcgact

SEQ ID NO: 214930 - DNA, 25 bp, E. coli
ttggacgtcgatagcaggcgcgact

SEQ ID NO: 214931 - DNA, 25 bp, E. coli
gaaccggaactcaacgtcgagctgc

SEQ ID NO: 214932 - DNA, 25 bp, E. coli
gaaccggaactctacgtcgagctgc

SEQ ID NO: 214933 - DNA, 25 bp, E. coli
cgttggtaacgtaggacgtcgattg

SEQ ID NO: 214934 - DNA, 25 bp, E. coli
cgttggtaacgttggacgtcgattg

SEQ ID NO: 214935 - DNA, 25 bp, E. coli
tggattttcactgtacgaccgtacg

SEQ ID NO: 214936 - DNA, 25 bp, E. coli
ggaactcaacgtcgagctgctgaaa

SEQ ID NO: 214937 - DNA, 25 bp, E. coli
tggattttcactctacgaccgtacg

SEQ ID NO: 214938 - DNA, 25 bp, E. coli
ggaactcaacgtggagctgctgaaa

SEQ ID NO: 214939 - DNA, 25 bp, E. coli
taacgttggacgacgattgcaggcg

SEQ ID NO: 214940 - DNA, 25 bp, E. coli
tttcactgtacgtccgtacggtggg

SEQ ID NO: 214941 - DNA, 25 bp, E. coli
tcaacgtcgagctgctgaaaaaagt

SEQ ID NO: 214942 - DNA, 25 bp, E. coli
taacgttggacgtcgattgcaggcg

SEQ ID NO: 214943 - DNA, 25 bp, E. coli
tttcactgtacgaccgtacggtggg

SEQ ID NO: 214944 - DNA, 25 bp, E. coli
tcaacgtcgagcagctgaaaaaagt

SEQ ID NO: 214945 - DNA, 25 bp, E. coli
aaccgcaacgttacagcagctacag

SEQ ID NO: 214946 - DNA, 25 bp, E. coli
ctaacaggtatcgtttggaggcagg

SEQ ID NO: 214947 - DNA, 25 bp, E. coli
ctaacaggtatcctttggaggcagg

SEQ ID NO: 214948 - DNA, 25 bp, E. coli
cagtttttatgttgaatgcccggcg

SEQ ID NO: 214949 - DNA, 25 bp, E. coli
cagtttttatgtagaatgcccggcg

SEQ ID NO: 214950 - DNA, 25 bp, E. coli
aaccgcaacgtttcagcagctacag

SEQ ID NO: 214951 - DNA, 25 bp, E. coli
tagaatattaaggtcgacaggtcag

SEQ ID NO: 214952 - DNA, 25 bp, E. coli
tagaatattaagctcgacaggtcag

SEQ ID NO: 214953 - DNA, 25 bp, E. coli
tgtatcagtgccaagcaaactcgga

SEQ ID NO: 214954 - DNA, 25 bp, E. coli
tgtatcagtgcctagcaaactcgga

SEQ ID NO: 214955 - DNA, 25 bp, E. coli
tgcaaatttcgtatccggaactccg

SEQ ID NO: 214956 - DNA, 25 bp, E. coli
tgcaaatttcgtttccggaactccg

SEQ ID NO: 214957 - DNA, 25 bp, E. coli
tcgcagtagatgtggtacaccaagc

SEQ ID NO: 214958 - DNA, 25 bp, E. coli
tcgcagtagatgaggtacaccaagc

SEQ ID NO: 214959 - DNA, 25 bp, E. coli
tccgagataaaatcaaacccgctag

SEQ ID NO: 214960 - DNA, 25 bp, E. coli
tccgagataaaaacaaacccgctag

SEQ ID NO: 214961 - DNA, 25 bp, E. coli
gccgcgactgcattatgggagagaa

SEQ ID NO: 214962 - DNA, 25 bp, E. coli
gccgcgactgcaatatgggagagaa

SEQ ID NO: 214963 - DNA, 25 bp, E. coli
cgaactggaggcaggaagacaaaca

SEQ ID NO: 214964 - DNA, 25 bp, E. coli
cgaactggaggctggaagacaaaca

SEQ ID NO: 214965 - DNA, 25 bp, E. coli
taatttagttccttcgtgccgcgac

SEQ ID NO: 214966 - DNA, 25 bp, E. coli
taatttagttccatcgtgccgcgac

SEQ ID NO: 214967 - DNA, 25 bp, E. coli
aacgctgggcgcagtgctttgagaa

SEQ ID NO: 214968 - DNA, 25 bp, E. coli
aactgctggctgtacgattaggcgc

SEQ ID NO: 214969 - DNA, 25 bp, E. coli
aacgctgggcgctgtgctttgagaa

SEQ ID NO: 214970 - DNA, 25 bp, E. coli
cacacccattgcgtggctgaacgaa

SEQ ID NO: 214971 - DNA, 25 bp, E. coli
cacacccattgcctggctgaacgaa

SEQ ID NO: 214972 - DNA, 25 bp, E. coli
cagtttgccgcgttgagtcatcagc

SEQ ID NO: 214973 - DNA, 25 bp, E. coli
cagtttgccgcgatgagtcatcagc

SEQ ID NO: 214974 - DNA, 25 bp, E. coli
aactgctggctgaacgattaggcgc

SEQ ID NO: 214975 - DNA, 25 bp, E. coli
tagaacaacgtcaactggcgctgga

SEQ ID NO: 214976 - DNA, 25 bp, E. coli
tagaacaacgtctactggcgctgga

SEQ ID NO: 214977 - DNA, 25 bp, E. coli
tatatcttcatcagcagcccggcat

SEQ ID NO: 214978 - DNA, 25 bp, E. coli
tatatcttcatctgcagcccggcat

SEQ ID NO: 214979 - DNA, 25 bp, E. coli
tttttgaagcgcctggatacccagc

SEQ ID NO: 214980 - DNA, 25 bp, E. coli
tttttgaagcgcgtggatacccagc

SEQ ID NO: 214981 - DNA, 25 bp, E. coli
tctacggcagcacggaaactggcgt

SEQ ID NO: 214982 - DNA, 25 bp, E. coli
tctacggcagcagggaaactggcgt

SEQ ID NO: 214983 - DNA, 25 bp, E. coli
gctgaacgaaagtacctggacgctg

SEQ ID NO: 214984 - DNA, 25 bp, E. coli
gctgaacgaaagaacctggacgctg

SEQ ID NO: 214985 - DNA, 25 bp, E. coli
ggtagcaagttcaccacaaatcgcg

SEQ ID NO: 214986 - DNA, 25 bp, E. coli
ggtagcaagttctccacaaatcgcg

SEQ ID NO: 214987 - DNA, 25 bp, E. coli
gatgtacaacataccgcgagctggc

SEQ ID NO: 214988 - DNA, 25 bp, E. coli
gatgtacaacattccgcgagctggc

SEQ ID NO: 214989 - DNA, 25 bp, E. coli
caacggtcggtaaattattgactga

SEQ ID NO: 214990 - DNA, 25 bp, E. coli
caccgcagcgcgcttatttgacagc

SEQ ID NO: 214991 - DNA, 25 bp, E. coli
caccgcagcgcggttatttgacagc

SEQ ID NO: 214992 - DNA, 25 bp, E. coli
caacggtcggtatattattgactga

SEQ ID NO: 214993 - DNA, 25 bp, E. coli
aaatggacaccgcagcgcggttatt

SEQ ID NO: 214994 - DNA, 25 bp, E. coli
aaatggacaccggagcgcggttatt

SEQ ID NO: 214995 - DNA, 25 bp, E. coli
tctggcaacggtgggtaaattattg

SEQ ID NO: 214996 - DNA, 25 bp, E. coli
tctggcaacggtcggtaaattattg

SEQ ID NO: 214997 - DNA, 25 bp, E. coli
cgctgagccgccatctggtgccggt

SEQ ID NO: 214998 - DNA, 25 bp, E. coli
cgctgagccgccttctggtgccggt

SEQ ID NO: 214999 - DNA, 25 bp, E. coli
ggcgttattttcaggcaacggtcgg

SEQ ID NO: 215000 - DNA, 25 bp, E. coli
ggcgttattttctggcaacggtcgg

SEQ ID NO: 215001 - DNA, 25 bp, E. coli
gtttatgcgggcgttattttctggc

SEQ ID NO: 215002 - DNA, 25 bp, E. coli
gtttatgcgggccttattttctggc

SEQ ID NO: 215003 - DNA, 25 bp, E. coli
gtcattctttcacaacaaaaacagg

SEQ ID NO: 215004 - DNA, 25 bp, E. coli
gtcattctttcagaacaaaaacagg

SEQ ID NO: 215005 - DNA, 25 bp, E. coli
gtcgatcgttattccgcctgcgcca

SEQ ID NO: 215006 - DNA, 25 bp, E. coli
gtcgatcgttataccgcctgcgcca

SEQ ID NO: 215007 - DNA, 25 bp, E. coli
tggtgacgccggtgtcgatcgttat

SEQ ID NO: 215008 - DNA, 25 bp, E. coli
tggtgacgccggagtcgatcgttat

SEQ ID NO: 215009 - DNA, 25 bp, E. coli
gagtcgatcgtttttccgcctgcgc

SEQ ID NO: 215010 - DNA, 25 bp, E. coli
gagtcgatcgttattccgcctgcgc

SEQ ID NO: 215011 - DNA, 25 bp, E. coli
cccagaacgcgtgaatcaaaccggg

SEQ ID NO: 215012 - DNA, 25 bp, E. coli
cccagaacgcgtcaatcaaaccggg

SEQ ID NO: 215013 - DNA, 25 bp, E. coli
cagaatattaattatgaacgcccaa

SEQ ID NO: 215014 - DNA, 25 bp, E. coli
cagaatattaataatgaacgcccaa

SEQ ID NO: 215015 - DNA, 25 bp, E. coli
caaaccggggatatacccaagcagt

SEQ ID NO: 215016 - DNA, 25 bp, E. coli
caaaccggggatttacccaagcagt

SEQ ID NO: 215017 - DNA, 25 bp, E. coli
tttgcacccagatcgcgtgaatcaa

SEQ ID NO: 215018 - DNA, 25 bp, E. coli
tttgcacccagaacgcgtgaatcaa

SEQ ID NO: 215019 - DNA, 25 bp, E. coli
tttaccgagcaggacgccgagcggc

SEQ ID NO: 215020 - DNA, 25 bp, E. coli
tttaccgagcagcacgccgagcggc

SEQ ID NO: 215021 - DNA, 25 bp, E. coli
tgatgacgattctccagaaacccat

SEQ ID NO: 215022 - DNA, 25 bp, E. coli
tgatgacgattcaccagaaacccat

SEQ ID NO: 215023 - DNA, 25 bp, E. coli
gaatgatggtgatgacgattctcca

SEQ ID NO: 215024 - DNA, 25 bp, E. coli
gaatgatggtgaagacgattctcca

SEQ ID NO: 215025 - DNA, 25 bp, E. coli
ccgagcggcggctgaatgatggtga

SEQ ID NO: 215026 - DNA, 25 bp, E. coli
ccgagcggcggcagaatgatggtga

SEQ ID NO: 215027 - DNA, 25 bp, E. coli
cgggtttgcacccagaacgcgtgaa

SEQ ID NO: 215028 - DNA, 25 bp, E. coli
cgggtttgcaccgagaacgcgtgaa

SEQ ID NO: 215029 - DNA, 25 bp, E. coli
taatcgcgggttagcacccagaacg

SEQ ID NO: 215030 - DNA, 25 bp, E. coli
taatcgcgggtttgcacccagaacg

SEQ ID NO: 215031 - DNA, 25 bp, E. coli
gatggtgatgacgattctccagaaa

SEQ ID NO: 215032 - DNA, 25 bp, E. coli
gatggtgatgaccattctccagaaa

SEQ ID NO: 215033 - DNA, 25 bp, E. coli
taaacgatatgacgagacgctaaaa

SEQ ID NO: 215034 - DNA, 25 bp, E. coli
taaacgatatgaggagacgctaaaa

SEQ ID NO: 215035 - DNA, 25 bp, E. coli
tatgacgagacgctaaaagaattga

SEQ ID NO: 215036 - DNA, 25 bp, E. coli
tatgacgagacggtaaaagaattga

SEQ ID NO: 215037 - DNA, 25 bp, E. coli
tatttatttatgttagctattggct

SEQ ID NO: 215038 - DNA, 25 bp, E. coli
tatttatttatgatagctattggct

SEQ ID NO: 215039 - DNA, 25 bp, E. coli
tgaatcctatcaattggttaagcgg

SEQ ID NO: 215040 - DNA, 25 bp, E. coli
tgaatcctatcatttggttaagcgg

SEQ ID NO: 215041 - DNA, 25 bp, E. coli
tagctattggctatcatgaggttgt

SEQ ID NO: 215042 - DNA, 25 bp, E. coli
tagctattggctttcatgaggttgt

SEQ ID NO: 215043 - DNA, 25 bp, E. coli
cctatcaattggttaagcggtggtt

SEQ ID NO: 215044 - DNA, 25 bp, E. coli
cctatcaattggataagcggtggtt

SEQ ID NO: 215045 - DNA, 25 bp, E. coli
gctatcatgaggttgtttttgatcg

SEQ ID NO: 215046 - DNA, 25 bp, E. coli
gctatcatgaggatgtttttgatcg

SEQ ID NO: 215047 - DNA, 25 bp, E. coli
gagacgctaaaagaattgaatccta

SEQ ID NO: 215048 - DNA, 25 bp, E. coli
gagacgctaaaacaattgaatccta

SEQ ID NO: 215049 - DNA, 25 bp, E. coli
cgatcgaatattaatttatgatagc

SEQ ID NO: 215050 - DNA, 25 bp, E. coli
cgatcgaatatttatttatgatagc

SEQ ID NO: 215051 - DNA, 25 bp, E. coli
cgttttaaacgaaatgacgagacgc

SEQ ID NO: 215052 - DNA, 25 bp, E. coli
cgttttaaacgatatgacgagacgc

SEQ ID NO: 215053 - DNA, 25 bp, E. coli
gttaagcggtggatttgccatgtga

SEQ ID NO: 215054 - DNA, 25 bp, E. coli
gttaagcggtggttttgccatgtga

SEQ ID NO: 215055 - DNA, 25 bp, E. coli
aatgcccgcgcgattgaatatctga

SEQ ID NO: 215056 - DNA, 25 bp, E. coli
aatgcccgcgcgtttgaatatctga

SEQ ID NO: 215057 - DNA, 25 bp, E. coli
catatctcctttgagcgtagcgcgc

SEQ ID NO: 215058 - DNA, 25 bp, E. coli
catatctcctttcagcgtagcgcgc

SEQ ID NO: 215059 - DNA, 25 bp, E. coli
aaagattgcctgtggtatgacgcgc

SEQ ID NO: 215060 - DNA, 25 bp, E. coli
aaagattgcctgaggtatgacgcgc

SEQ ID NO: 215061 - DNA, 25 bp, E. coli
aactgaacggtaacggctttgccca

SEQ ID NO: 215062 - DNA, 25 bp, E. coli
aactgaacggtatcggctttgccca

SEQ ID NO: 215063 - DNA, 25 bp, E. coli
tatgtctcggatggtcgctggaaaa

SEQ ID NO: 215064 - DNA, 25 bp, E. coli
tatgtctcggatcgtcgctggaaaa

SEQ ID NO: 215065 - DNA, 25 bp, E. coli
ttgaagccagcctacaggatgtcgg

SEQ ID NO: 215066 - DNA, 25 bp, E. coli
ttgaagccagccaacaggatgtcgg

SEQ ID NO: 215067 - DNA, 25 bp, E. coli
tgaaagtgtgttgctccttggcccg

SEQ ID NO: 215068 - DNA, 25 bp, E. coli
gccaaaagtttgatcgcccggcgct

SEQ ID NO: 215069 - DNA, 25 bp, E. coli
gccaaaagtttgttcgcccggcgct

SEQ ID NO: 215070 - DNA, 25 bp, E. coli
gattggtgaaattacgctgcccgat

SEQ ID NO: 215071 - DNA, 25 bp, E. coli
gattggtgaaataacgctgcccgat

SEQ ID NO: 215072 - DNA, 25 bp, E. coli
ggcccgccaggttttgccaaaagtt

SEQ ID NO: 215073 - DNA, 25 bp, E. coli
tgaaagtgtgttcctccttggcccg

SEQ ID NO: 215074 - DNA, 25 bp, E. coli
ggcccgccaggtattgccaaaagtt

SEQ ID NO: 215075 - DNA, 25 bp, E. coli
taacggtaattcctctgggcggcat

SEQ ID NO: 215076 - DNA, 25 bp, E. coli
taacggtaattcgtctgggcggcat

SEQ ID NO: 215077 - DNA, 25 bp, E. coli
aaacggcttttacagcaagtcatcg

SEQ ID NO: 215078 - DNA, 25 bp, E. coli
acagcaagtcatggtgctggattcg

SEQ ID NO: 215079 - DNA, 25 bp, E. coli
aaacggcttttagagcaagtcatcg

SEQ ID NO: 215080 - DNA, 25 bp, E. coli
acagcaagtcatcgtgctggattcg

SEQ ID NO: 215081 - DNA, 25 bp, E. coli
tagcagcggtattgagtgaaaaacg

SEQ ID NO: 215082 - DNA, 25 bp, E. coli
tatgctacgcccaacgctgattgcc

SEQ ID NO: 215083 - DNA, 25 bp, E. coli
tatggtgtacctggcggcgtactat

SEQ ID NO: 215084 - DNA, 25 bp, E. coli
tatgctacgccctacgctgattgcc

SEQ ID NO: 215085 - DNA, 25 bp, E. coli
tatggtgtacctcgcggcgtactat

SEQ ID NO: 215086 - DNA, 25 bp, E. coli
tagcagcggtatagagtgaaaaacg

SEQ ID NO: 215087 - DNA, 25 bp, E. coli
ttttacgtgaaaagtccgcttatgc

SEQ ID NO: 215088 - DNA, 25 bp, E. coli
ttttacgtgaaatgtccgcttatgc

SEQ ID NO: 215089 - DNA, 25 bp, E. coli
gccgattttatttccggcactgccg

SEQ ID NO: 215090 - DNA, 25 bp, E. coli
gccgattttattaccggcactgccg

SEQ ID NO: 215091 - DNA, 25 bp, E. coli
gaaatgtccgcttatgctacgccct

SEQ ID NO: 215092 - DNA, 25 bp, E. coli
gaaatgtccgctaatgctacgccct

SEQ ID NO: 215093 - DNA, 25 bp, E. coli
gcggtattgagtcaaaaacggcttt

SEQ ID NO: 215094 - DNA, 25 bp, E. coli
gcggtattgagtgaaaaacggcttt

SEQ ID NO: 215095 - DNA, 25 bp, E. coli
tgggctgggcttgacgctggcggtg

SEQ ID NO: 215096 - DNA, 25 bp, E. coli
ggctatctgctaaggtgtacctggc

SEQ ID NO: 215097 - DNA, 25 bp, E. coli
tgggctgggcttcacgctggcggtg

SEQ ID NO: 215098 - DNA, 25 bp, E. coli
ggctatctgctatggtgtacctggc

SEQ ID NO: 215099 - DNA, 25 bp, E. coli
aatcggtctggtggcagcgattccg

SEQ ID NO: 215100 - DNA, 25 bp, E. coli
aatcggtctggtcgcagcgattccg

SEQ ID NO: 215101 - DNA, 25 bp, E. coli
atctataacgtaatcgcgcgtcaga

SEQ ID NO: 215102 - DNA, 25 bp, E. coli
acgtattcgcgcgtcagattggcgg

SEQ ID NO: 215103 - DNA, 25 bp, E. coli
attcgcgcgtcacattggcggcttt

SEQ ID NO: 215104 - DNA, 25 bp, E. coli
atctataacgtattcgcgcgtcaga

SEQ ID NO: 215105 - DNA, 25 bp, E. coli
attcgcgcgtcagattggcggcttt

SEQ ID NO: 215106 - DNA, 25 bp, E. coli
acgtattcgcgcctcagattggcgg

SEQ ID NO: 215107 - DNA, 25 bp, E. coli
tattcgcgcgtctgattggcggctt

SEQ ID NO: 215108 - DNA, 25 bp, E. coli
tataacgtattcccgcgtcagattg

SEQ ID NO: 215109 - DNA, 25 bp, E. coli
tatctataacgtattcgcgcgtcag

SEQ ID NO: 215110 - DNA, 25 bp, E. coli
tatctataacgttttcgcgcgtcag

SEQ ID NO: 215111 - DNA, 25 bp, E. coli
tattcgcgcgtcagattggcggctt

SEQ ID NO: 215112 - DNA, 25 bp, E. coli
tataacgtattcgcgcgtcagattg

SEQ ID NO: 215113 - DNA, 25 bp, E. coli
tctataacgtattcgcgcgtcagat

SEQ ID NO: 215114 - DNA, 25 bp, E. coli
tctggtggcagcgattccggcggtc

SEQ ID NO: 215115 - DNA, 25 bp, E. coli
tctataacgtatacgcgcgtcagat

SEQ ID NO: 215116 - DNA, 25 bp, E. coli
tctggtggcagccattccggcggtc

SEQ ID NO: 215117 - DNA, 25 bp, E. coli
cgtattcgcgcgtcagattggcggc

SEQ ID NO: 215118 - DNA, 25 bp, E. coli
cgtattcgcgcgacagattggcggc

SEQ ID NO: 215119 - DNA, 25 bp, E. coli
ctataacgtattcgcgcgtcagatt

SEQ ID NO: 215120 - DNA, 25 bp, E. coli
ctataacgtattggcgcgtcagatt

SEQ ID NO: 215121 - DNA, 25 bp, E. coli
cagcgacgatcaccgtcgatggatt

SEQ ID NO: 215122 - DNA, 25 bp, E. coli
cagcgacgatcagcgtcgatggatt

SEQ ID NO: 215123 - DNA, 25 bp, E. coli
catcctggattggaaaatgctgaac

SEQ ID NO: 215124 - DNA, 25 bp, E. coli
catcctggattgcaaaatgctgaac

SEQ ID NO: 215125 - DNA, 25 bp, E. coli
ttgtgtaaaacggtggttagttaca

SEQ ID NO: 215126 - DNA, 25 bp, E. coli
aggtcacggtggatcagcgacgatc

SEQ ID NO: 215127 - DNA, 25 bp, E. coli
aggtcacggtggttcagcgacgatc

SEQ ID NO: 215128 - DNA, 25 bp, E. coli
accggcttattgagtaaaacgctgg

SEQ ID NO: 215129 - DNA, 25 bp, E. coli
accggcttattgtgtaaaacgctgg

SEQ ID NO: 215130 - DNA, 25 bp, E. coli
ttgtgtaaaacgctggttagttaca

SEQ ID NO: 215131 - DNA, 25 bp, E. coli
ttgatgatgtcagcggcttattgtg

SEQ ID NO: 215132 - DNA, 25 bp, E. coli
ttgatgatgtcaccggcttattgtg

SEQ ID NO: 215133 - DNA, 25 bp, E. coli
tgtcaccggctttttgtgtaaaacg

SEQ ID NO: 215134 - DNA, 25 bp, E. coli
tgtcaccggcttattgtgtaaaacg

SEQ ID NO: 215135 - DNA, 25 bp, E. coli
gcgcagcgttttcgtacagaaccgt

SEQ ID NO: 215136 - DNA, 25 bp, E. coli
gcgcagcgttttggtacagaaccgt

SEQ ID NO: 215137 - DNA, 25 bp, E. coli
gcttattgtgtaaaacgctggttag

SEQ ID NO: 215138 - DNA, 25 bp, E. coli
gcttattgtgtataacgctggttag

SEQ ID NO: 215139 - DNA, 25 bp, E. coli
cgaaggcgggcatcctggattgcaa

SEQ ID NO: 215140 - DNA, 25 bp, E. coli
cgaaggcgggcaacctggattgcaa

SEQ ID NO: 215141 - DNA, 25 bp, E. coli
cggtggttcagcgacgatcagcgtc

SEQ ID NO: 215142 - DNA, 25 bp, E. coli
cggtggttcagccacgatcagcgtc

SEQ ID NO: 215143 - DNA, 25 bp, E. coli
aataagacggttatcgttgccgccg

SEQ ID NO: 215144 - DNA, 25 bp, E. coli
aataagacggttttcgttgccgccg

SEQ ID NO: 215145 - DNA, 25 bp, E. coli
aatatcaacgttgccagactcgccg

SEQ ID NO: 215146 - DNA, 25 bp, E. coli
caacggctgctatcgggcatttgca

SEQ ID NO: 215147 - DNA, 25 bp, E. coli
aatatcaacgttcccagactcgccg

SEQ ID NO: 215148 - DNA, 25 bp, E. coli
caacttggtgtcactggcgtgacga

SEQ ID NO: 215149 - DNA, 25 bp, E. coli
caacggctgctaacgggcatttgca

SEQ ID NO: 215150 - DNA, 25 bp, E. coli
caacttggtgtctctggcgtgacga

SEQ ID NO: 215151 - DNA, 25 bp, E. coli
tgcagaaattgtagccgcccagggt

SEQ ID NO: 215152 - DNA, 25 bp, E. coli
tgcagaaattgttgccgcccagggt

SEQ ID NO: 215153 - DNA, 25 bp, E. coli
tcatttggcggtgctattgcgacac

SEQ ID NO: 215154 - DNA, 25 bp, E. coli
tcatttggcggtcctattgcgacac

SEQ ID NO: 215155 - DNA, 25 bp, E. coli
gaaaatgtgatcctcagccgcagca

SEQ ID NO: 215156 - DNA, 25 bp, E. coli
gacacgctatttcttggacatggga

SEQ ID NO: 215157 - DNA, 25 bp, E. coli
gaaaatgtgatcgtcagccgcagca

SEQ ID NO: 215158 - DNA, 25 bp, E. coli
gaaaaaactgcgtctgatcaccaac

SEQ ID NO: 215159 - DNA, 25 bp, E. coli
gaaaaaactgcgactgatcaccaac

SEQ ID NO: 215160 - DNA, 25 bp, E. coli
gacacgctatttgttggacatggga

SEQ ID NO: 215161 - DNA, 25 bp, E. coli
cgcactggccggaaaacagcttgaa

SEQ ID NO: 215162 - DNA, 25 bp, E. coli
cgcactggccggtaaacagcttgaa

SEQ ID NO: 215163 - DNA, 25 bp, E. coli
gatgacttatctccgcaacttggtg

SEQ ID NO: 215164 - DNA, 25 bp, E. coli
gatgacttatctgcgcaacttggtg

SEQ ID NO: 215165 - DNA, 25 bp, E. coli
aattaacctggttggactggtcgca

SEQ ID NO: 215166 - DNA, 25 bp, E. coli
aattaacctggtaggactggtcgca

SEQ ID NO: 215167 - DNA, 25 bp, E. coli
aatgaacctgactatcgcgacaacg

SEQ ID NO: 215168 - DNA, 25 bp, E. coli
aatgaacctgacaatcgcgacaacg

SEQ ID NO: 215169 - DNA, 25 bp, E. coli
acaacgttgttggtctcccagggta

SEQ ID NO: 215170 - DNA, 25 bp, E. coli
aacatcgctatgtcttgccagggca

SEQ ID NO: 215171 - DNA, 25 bp, E. coli
aacatcgctatgacttgccagggca

SEQ ID NO: 215172 - DNA, 25 bp, E. coli
acaacgttgttgctctcccagggta

SEQ ID NO: 215173 - DNA, 25 bp, E. coli
tatgactgggaacatgatgccccgc

SEQ ID NO: 215174 - DNA, 25 bp, E. coli
tatggttatcgcgttcatggcccct

SEQ ID NO: 215175 - DNA, 25 bp, E. coli
tatgactgggaagatgatgccccgc

SEQ ID NO: 215176 - DNA, 25 bp, E. coli
tatggttatcgccttcatggcccct

SEQ ID NO: 215177 - DNA, 25 bp, E. coli
tatcgtgctcaagcatagtgcggaa

SEQ ID NO: 215178 - DNA, 25 bp, E. coli
tatcgtgctcaaccatagtgcggaa

SEQ ID NO: 215179 - DNA, 25 bp, E. coli
tgttgattgatcgttgcgcgcggca

SEQ ID NO: 215180 - DNA, 25 bp, E. coli
tgttgattgatccttgcgcgcggca

SEQ ID NO: 215181 - DNA, 25 bp, E. coli
tgattacggctgtctggcagggacc

SEQ ID NO: 215182 - DNA, 25 bp, E. coli
tgattacggctgactggcagggacc

SEQ ID NO: 215183 - DNA, 25 bp, E. coli
taacgccacgcttgaggtaacagag

SEQ ID NO: 215184 - DNA, 25 bp, E. coli
taacgccacgctagaggtaacagag

SEQ ID NO: 215185 - DNA, 25 bp, E. coli
gagtttaaagataacccgctgctgc

SEQ ID NO: 215186 - DNA, 25 bp, E. coli
gagtttaaagattacccgctgctgc

SEQ ID NO: 215187 - DNA, 25 bp, E. coli
caatttggaataaggcgatgggagc

SEQ ID NO: 215188 - DNA, 25 bp, E. coli
aatataaaactggtggagggcttcc

SEQ ID NO: 215189 - DNA, 25 bp, E. coli
aatataaaactgctggagggcttcc

SEQ ID NO: 215190 - DNA, 25 bp, E. coli
caatttggaatatggcgatgggagc

SEQ ID NO: 215191 - DNA, 25 bp, E. coli
cagtaggccatcgatatcctgagga

SEQ ID NO: 215192 - DNA, 25 bp, E. coli
cagtaggccatccatatcctgagga

SEQ ID NO: 215193 - DNA, 25 bp, E. coli
tatgtcatcaggtgcggtgacagcc

SEQ ID NO: 215194 - DNA, 25 bp, E. coli
tagataagaccgcacctgttgaacc

SEQ ID NO: 215195 - DNA, 25 bp, E. coli
tagataagaccggacctgttgaacc

SEQ ID NO: 215196 - DNA, 25 bp, E. coli
tatgtcatcaggagcggtgacagcc

SEQ ID NO: 215197 - DNA, 25 bp, E. coli
tatatggcacaacagcaggtacgta

SEQ ID NO: 215198 - DNA, 25 bp, E. coli
tatatggcacaagagcaggtacgta

SEQ ID NO: 215199 - DNA, 25 bp, E. coli
tgattctccggtccttgaagacacg

SEQ ID NO: 215200 - DNA, 25 bp, E. coli
tgattctccggtgcttgaagacacg

SEQ ID NO: 215201 - DNA, 25 bp, E. coli
tcccatatgaatggcgggcagcagt

SEQ ID NO: 215202 - DNA, 25 bp, E. coli
tcccatatgaatcgcgggcagcagt

SEQ ID NO: 215203 - DNA, 25 bp, E. coli
gctagagatatattggcacacccat

SEQ ID NO: 215204 - DNA, 25 bp, E. coli
gctagagatataatggcacacccat

SEQ ID NO: 215205 - DNA, 25 bp, E. coli
gattcgattgccgagagcattgcca

SEQ ID NO: 215206 - DNA, 25 bp, E. coli
gattcgattgcccagagcattgcca

SEQ ID NO: 215207 - DNA, 25 bp, E. coli
ggcacaaccggttttcaagctgaaa

SEQ ID NO: 215208 - DNA, 25 bp, E. coli
ggcacaaccggtattcaagctgaaa

SEQ ID NO: 215209 - DNA, 25 bp, E. coli
caatcgacaattccctggtaaaagc

SEQ ID NO: 215210 - DNA, 25 bp, E. coli
caatatgaacgtatgcgtcgcgatg

SEQ ID NO: 215211 - DNA, 25 bp, E. coli
caatcgacaattgcctggtaaaagc

SEQ ID NO: 215212 - DNA, 25 bp, E. coli
caatatgaacgtttgcgtcgcgatg

SEQ ID NO: 215213 - DNA, 25 bp, E. coli
cacgcaaaggtaattcttggatgaa

SEQ ID NO: 215214 - DNA, 25 bp, E. coli
cacgcaaaggtatttcttggatgaa

SEQ ID NO: 215215 - DNA, 25 bp, E. coli
catgtcaccaaatttaatgaagaga

SEQ ID NO: 215216 - DNA, 25 bp, E. coli
catgtcaccaaaattaatgaagaga

SEQ ID NO: 215217 - DNA, 25 bp, E. coli
tcgcgatgttgaggaaatatcacgc

SEQ ID NO: 215218 - DNA, 25 bp, E. coli
tgcctggtaaaaccgtgacacatgt

SEQ ID NO: 215219 - DNA, 25 bp, E. coli
tgcctggtaaaagcgtgacacatgt

SEQ ID NO: 215220 - DNA, 25 bp, E. coli
tcgcgatgttgacgaaatatcacgc

SEQ ID NO: 215221 - DNA, 25 bp, E. coli
gcatccgcctttcaacatatcaaaa

SEQ ID NO: 215222 - DNA, 25 bp, E. coli
gcatccgcctttgaacatatcaaaa

SEQ ID NO: 215223 - DNA, 25 bp, E. coli
gaaatgttgtgtgcggatttgcatc

SEQ ID NO: 215224 - DNA, 25 bp, E. coli
gaaatgttgtgtccggatttgcatc

SEQ ID NO: 215225 - DNA, 25 bp, E. coli
cccaatcctgtcttttgaaatgttg

SEQ ID NO: 215226 - DNA, 25 bp, E. coli
cccaatcctgtcatttgaaatgttg

SEQ ID NO: 215227 - DNA, 25 bp, E. coli
cttggatgaataagctggtttagag

SEQ ID NO: 215228 - DNA, 25 bp, E. coli
cttggatgaatatgctggtttagag

SEQ ID NO: 215229 - DNA, 25 bp, E. coli
gaggatttatttagagcaatcgaca

SEQ ID NO: 215230 - DNA, 25 bp, E. coli
gaggatttattttgagcaatcgaca

SEQ ID NO: 215231 - DNA, 25 bp, E. coli
caacataaactctttgcctggctta

SEQ ID NO: 215232 - DNA, 25 bp, E. coli
caacataaactcattgcctggctta

SEQ ID NO: 215233 - DNA, 25 bp, E. coli
caggcgcaaattaccccttgttgca

SEQ ID NO: 215234 - DNA, 25 bp, E. coli
caggcgcaaatttccccttgttgca

SEQ ID NO: 215235 - DNA, 25 bp, E. coli
ttgtcggcgttgagttaattaccca

SEQ ID NO: 215236 - DNA, 25 bp, E. coli
ttgtcggcgttgtgttaattaccca

SEQ ID NO: 215237 - DNA, 25 bp, E. coli
attgctatttcctgccgataagaga

SEQ ID NO: 215238 - DNA, 25 bp, E. coli
attgctatttccagccgataagaga

SEQ ID NO: 215239 - DNA, 25 bp, E. coli
tgttgattaatgagaattacccgca

SEQ ID NO: 215240 - DNA, 25 bp, E. coli
tgttgattaatgtgaattacccgca

SEQ ID NO: 215241 - DNA, 25 bp, E. coli
taattacccattactccagtgaaga

SEQ ID NO: 215242 - DNA, 25 bp, E. coli
taattacccatttctccagtgaaga

SEQ ID NO: 215243 - DNA, 25 bp, E. coli
ccttgtgttaggtaatttgggagca

SEQ ID NO: 215244 - DNA, 25 bp, E. coli
ccttgtgttaggaaatttgggagca

SEQ ID NO: 215245 - DNA, 25 bp, E. coli
ccgacgagtcgggttatagcgcaac

SEQ ID NO: 215246 - DNA, 25 bp, E. coli
ccgacgagtcggcttatagcgcaac

SEQ ID NO: 215247 - DNA, 25 bp, E. coli
gataacgacgttcgttcagcgataa

SEQ ID NO: 215248 - DNA, 25 bp, E. coli
gatttccatgctctccagggatgcc

SEQ ID NO: 215249 - DNA, 25 bp, E. coli
gataacgacgttggttcagcgataa

SEQ ID NO: 215250 - DNA, 25 bp, E. coli
gatttccatgctgtccagggatgcc

SEQ ID NO: 215251 - DNA, 25 bp, E. coli
ggcttaatttaaggccacaagtggc

SEQ ID NO: 215252 - DNA, 25 bp, E. coli
ggcttaatttaacgccacaagtggc

SEQ ID NO: 215253 - DNA, 25 bp, E. coli
aattccggtttaacaactggctgac

SEQ ID NO: 215254 - DNA, 25 bp, E. coli
aattccggtttatcaactggctgac

SEQ ID NO: 215255 - DNA, 25 bp, E. coli
actgaatgtagcgacatctgggcgc

SEQ ID NO: 215256 - DNA, 25 bp, E. coli
aaacaagggattatgctcgccgacg

SEQ ID NO: 215257 - DNA, 25 bp, E. coli
aaacaagggattttgctcgccgacg

SEQ ID NO: 215258 - DNA, 25 bp, E. coli
actgaatgtagccacatctgggcgc

SEQ ID NO: 215259 - DNA, 25 bp, E. coli
tttcaacgattaatgccccgacggc

SEQ ID NO: 215260 - DNA, 25 bp, E. coli
tttcaacgattattgccccgacggc

SEQ ID NO: 215261 - DNA, 25 bp, E. coli
tgtgctgatcgtttaatgcctgcgc

SEQ ID NO: 215262 - DNA, 25 bp, E. coli
tgtgctgatcgtataatgcctgcgc

SEQ ID NO: 215263 - DNA, 25 bp, E. coli
tctgggcgctgcaaggtaaatcaac

SEQ ID NO: 215264 - DNA, 25 bp, E. coli
tcaggcgctgcaactgcaactggcg

SEQ ID NO: 215265 - DNA, 25 bp, E. coli
tctgggcgctgctaggtaaatcaac

SEQ ID NO: 215266 - DNA, 25 bp, E. coli
tcaggcgctgcatctgcaactggcg

SEQ ID NO: 215267 - DNA, 25 bp, E. coli
gctggaaatttcacgccggatacgc

SEQ ID NO: 215268 - DNA, 25 bp, E. coli
gctggaaatttctcgccggatacgc

SEQ ID NO: 215269 - DNA, 25 bp, E. coli
gtaaatcaaccgaaaccaatccgct

SEQ ID NO: 215270 - DNA, 25 bp, E. coli
ggttcgcccactctatcaactctgg

SEQ ID NO: 215271 - DNA, 25 bp, E. coli
gtaaatcaaccgtaaccaatccgct

SEQ ID NO: 215272 - DNA, 25 bp, E. coli
ggttcgcccactgtatcaactctgg

SEQ ID NO: 215273 - DNA, 25 bp, E. coli
taagccagccattgatacgccagca

SEQ ID NO: 215274 - DNA, 25 bp, E. coli
taagccagccatagatacgccagca

SEQ ID NO: 215275 - DNA, 25 bp, E. coli
cagccgccgctgtacaaagtgaaga

SEQ ID NO: 215276 - DNA, 25 bp, E. coli
cagccgccgctgaacaaagtgaaga

SEQ ID NO: 215277 - DNA, 25 bp, E. coli
taaacgccctgtcgcaaaaactgga

SEQ ID NO: 215278 - DNA, 25 bp, E. coli
taaacgccctgtggcaaaaactgga

SEQ ID NO: 215279 - DNA, 25 bp, E. coli
aaatgacccgccgtaaaggtgcgct

SEQ ID NO: 215280 - DNA, 25 bp, E. coli
aaatgacccgccctaaaggtgcgct

SEQ ID NO: 215281 - DNA, 25 bp, E. coli
tatcggcggcggtagtgatcatgac

SEQ ID NO: 215282 - DNA, 25 bp, E. coli
tatcggcggcggaagtgatcatgac

SEQ ID NO: 215283 - DNA, 25 bp, E. coli
tgtatatcggcgtcacggatgacgg

SEQ ID NO: 215284 - DNA, 25 bp, E. coli
tgtatatcggcgacacggatgacgg

SEQ ID NO: 215285 - DNA, 25 bp, E. coli
tcctcaacgtcgagaaagcgcgctt

SEQ ID NO: 215286 - DNA, 25 bp, E. coli
tcctcaacgtcgtgaaagcgcgctt

SEQ ID NO: 215287 - DNA, 25 bp, E. coli
tcctataaagtgaccggcggtctgc

SEQ ID NO: 215288 - DNA, 25 bp, E. coli
tcctataaagtgtccggcggtctgc

SEQ ID NO: 215289 - DNA, 25 bp, E. coli
tcttctcaggaactggcgacgctta

SEQ ID NO: 215290 - DNA, 25 bp, E. coli
tcttctcaggaagtggcgacgctta

SEQ ID NO: 215291 - DNA, 25 bp, E. coli
tcagatctacgatcacggtgtaccg

SEQ ID NO: 215292 - DNA, 25 bp, E. coli
tcagatctacgaacacggtgtaccg

SEQ ID NO: 215293 - DNA, 25 bp, E. coli
gcgctcgcgggtcactgtaaagaaa

SEQ ID NO: 215294 - DNA, 25 bp, E. coli
gcgctcgcgggtgactgtaaagaaa

SEQ ID NO: 215295 - DNA, 25 bp, E. coli
gaatatcgtcgtttctgcacgctgg

SEQ ID NO: 215296 - DNA, 25 bp, E. coli
gaatatcgtcgtatctgcacgctgg

SEQ ID NO: 215297 - DNA, 25 bp, E. coli
cattaccttcatgaacgtctcgtaa

SEQ ID NO: 215298 - DNA, 25 bp, E. coli
cattaccttcatcaacgtctcgtaa

SEQ ID NO: 215299 - DNA, 25 bp, E. coli
taccttcatcaacgtctcgtaatcg

SEQ ID NO: 215300 - DNA, 25 bp, E. coli
agaagatggtggtgtctttcttgcc

SEQ ID NO: 215301 - DNA, 25 bp, E. coli
agaagatggtggagtctttcttgcc

SEQ ID NO: 215302 - DNA, 25 bp, E. coli
taccttcatcaaggtctcgtaatcg

SEQ ID NO: 215303 - DNA, 25 bp, E. coli
tggtgtctttcttgccttcggttaa

SEQ ID NO: 215304 - DNA, 25 bp, E. coli
tggtggtgtcttacttgccttcggt

SEQ ID NO: 215305 - DNA, 25 bp, E. coli
tggtgtctttctagccttcggttaa

SEQ ID NO: 215306 - DNA, 25 bp, E. coli
tccattaccttcttcaacgtctcgt

SEQ ID NO: 215307 - DNA, 25 bp, E. coli
tccattaccttcatcaacgtctcgt

SEQ ID NO: 215308 - DNA, 25 bp, E. coli
tcaggtaacccggctgatgcagcgt

SEQ ID NO: 215309 - DNA, 25 bp, E. coli
tcaggtaacccgcctgatgcagcgt

SEQ ID NO: 215310 - DNA, 25 bp, E. coli
ccttcatcaacgactcgtaatcgac

SEQ ID NO: 215311 - DNA, 25 bp, E. coli
ccttcatcaacgtctcgtaatcgac

SEQ ID NO: 215312 - DNA, 25 bp, E. coli
gaagatggtggtgtctttcttgcct

SEQ ID NO: 215313 - DNA, 25 bp, E. coli
gaagatggtggtctctttcttgcct

SEQ ID NO: 215314 - DNA, 25 bp, E. coli
cggaagaagatggtggtgtctttct

SEQ ID NO: 215315 - DNA, 25 bp, E. coli
cggaagaagatgctggtgtctttct

SEQ ID NO: 215316 - DNA, 25 bp, E. coli
tggtggtgtctttcttgccttcggt

SEQ ID NO: 215317 - DNA, 25 bp, E. coli
gatggtggtgtctttcttgccttcg

SEQ ID NO: 215318 - DNA, 25 bp, E. coli
gatggtggtgtcattcttgccttcg

SEQ ID NO: 215319 - DNA, 25 bp, E. coli
tacgagcagcgtttcggtatgcgtt

SEQ ID NO: 215320 - DNA, 25 bp, E. coli
tacgagcagcgtatcggtatgcgtt

SEQ ID NO: 215321 - DNA, 25 bp, E. coli
tattcagcttaaccctgattccgca

SEQ ID NO: 215322 - DNA, 25 bp, E. coli
tattcagcttaagcctgattccgca

SEQ ID NO: 215323 - DNA, 25 bp, E. coli
tttcggtatgcgttcctccagcctg

SEQ ID NO: 215324 - DNA, 25 bp, E. coli
ttccgcaaatgaacgcggtacgctg

SEQ ID NO: 215325 - DNA, 25 bp, E. coli
tttcggtatgcgatcctccagcctg

SEQ ID NO: 215326 - DNA, 25 bp, E. coli
ttaagcctgattccgcaaatgaacg

SEQ ID NO: 215327 - DNA, 25 bp, E. coli
ttccgcaaatgatcgcggtacgctg

SEQ ID NO: 215328 - DNA, 25 bp, E. coli
ttaagcctgattgcgcaaatgaacg

SEQ ID NO: 215329 - DNA, 25 bp, E. coli
tgttaatttcgtacccacaccgtgg

SEQ ID NO: 215330 - DNA, 25 bp, E. coli
tgttaatttcgttcccacaccgtgg

SEQ ID NO: 215331 - DNA, 25 bp, E. coli
tctgtttgtactgatgagtgtggct

SEQ ID NO: 215332 - DNA, 25 bp, E. coli
tctgtttgtactcatgagtgtggct

SEQ ID NO: 215333 - DNA, 25 bp, E. coli
gaagctattttatcagtacgagcag

SEQ ID NO: 215334 - DNA, 25 bp, E. coli
gaagctattttaacagtacgagcag

SEQ ID NO: 215335 - DNA, 25 bp, E. coli
ctggccctgccgatatttgttctgt

SEQ ID NO: 215336 - DNA, 25 bp, E. coli
ctggccctgccgttatttgttctgt

SEQ ID NO: 215337 - DNA, 25 bp, E. coli
gatatgtaaaatatttaaccgcctg

SEQ ID NO: 215338 - DNA, 25 bp, E. coli
gatatgtaaaatttttaaccgcctg

SEQ ID NO: 215339 - DNA, 25 bp, E. coli
gatgagtgtggcagttaatttcgta

SEQ ID NO: 215340 - DNA, 25 bp, E. coli
gatgagtgtggctgttaatttcgta

SEQ ID NO: 215341 - DNA, 25 bp, E. coli
cccaggatactaagtttcttttggg

SEQ ID NO: 215342 - DNA, 25 bp, E. coli
cccaggatactatgtttcttttggg

SEQ ID NO: 215343 - DNA, 25 bp, E. coli
aacctgctggattttgacaatcttg

SEQ ID NO: 215344 - DNA, 25 bp, E. coli
aacctgctggatattgacaatcttg

SEQ ID NO: 215345 - DNA, 25 bp, E. coli
tattcgtcgcgatagcccgaagaaa

SEQ ID NO: 215346 - DNA, 25 bp, E. coli
tattcgtcgcgaaagcccgaagaaa

SEQ ID NO: 215347 - DNA, 25 bp, E. coli
tcgcgatagccccaagaaagcaatt

SEQ ID NO: 215348 - DNA, 25 bp, E. coli
tcgcgatagcccgaagaaagcaatt

SEQ ID NO: 215349 - DNA, 25 bp, E. coli
gcagattcaacagacacaggacgta

SEQ ID NO: 215350 - DNA, 25 bp, E. coli
gcagattcaacacacacaggacgta

SEQ ID NO: 215351 - DNA, 25 bp, E. coli
gacgtaacccaggatactatgtttc

SEQ ID NO: 215352 - DNA, 25 bp, E. coli
gacaatcttgacgttgataaacttg

SEQ ID NO: 215353 - DNA, 25 bp, E. coli
gacgtaacccagcatactatgtttc

SEQ ID NO: 215354 - DNA, 25 bp, E. coli
gacacaggacgttacccaggatact

SEQ ID NO: 215355 - DNA, 25 bp, E. coli
gacacaggacgtaacccaggatact

SEQ ID NO: 215356 - DNA, 25 bp, E. coli
gacaatcttgaccttgataaacttg

SEQ ID NO: 215357 - DNA, 25 bp, E. coli
cgttgataaactagatattcatgct

SEQ ID NO: 215358 - DNA, 25 bp, E. coli
cgttgataaacttgatattcatgct

SEQ ID NO: 215359 - DNA, 25 bp, E. coli
cgatagcccgaacaaagcaattacc

SEQ ID NO: 215360 - DNA, 25 bp, E. coli
cgatagcccgaagaaagcaattacc

SEQ ID NO: 215361 - DNA, 25 bp, E. coli
tcaacagacacacgacgtaacccag

SEQ ID NO: 215362 - DNA, 25 bp, E. coli
tcaacagacacaggacgtaacccag

SEQ ID NO: 215363 - DNA, 25 bp, E. coli
aatgccagagttccccgttgcgaaa

SEQ ID NO: 215364 - DNA, 25 bp, E. coli
aatgccagagttgcccgttgcgaaa

SEQ ID NO: 215365 - DNA, 25 bp, E. coli
caaataatggcgtctgcttgtcaga

SEQ ID NO: 215366 - DNA, 25 bp, E. coli
caaataatggcgactgcttgtcaga

SEQ ID NO: 215367 - DNA, 25 bp, E. coli
catccaggcgttaatgggagcgtca

SEQ ID NO: 215368 - DNA, 25 bp, E. coli
catccaggcgtttatgggagcgtca

SEQ ID NO: 215369 - DNA, 25 bp, E. coli
actgcggcacgtactctcataaggc

SEQ ID NO: 215370 - DNA, 25 bp, E. coli
actgcggcacgttctctcataaggc

SEQ ID NO: 215371 - DNA, 25 bp, E. coli
tatccgtgggagtggaatacacgct

SEQ ID NO: 215372 - DNA, 25 bp, E. coli
tatccgtgggagaggaatacacgct

SEQ ID NO: 215373 - DNA, 25 bp, E. coli
tttatgtaagaatgtgcaccgccac

SEQ ID NO: 215374 - DNA, 25 bp, E. coli
tttatgtaagaaagtgcaccgccac

SEQ ID NO: 215375 - DNA, 25 bp, E. coli
tcagataattaagccgtcactgcgg

SEQ ID NO: 215376 - DNA, 25 bp, E. coli
tcattcccggaactgacttcaggcg

SEQ ID NO: 215377 - DNA, 25 bp, E. coli
tcattcccggaagtgacttcaggcg

SEQ ID NO: 215378 - DNA, 25 bp, E. coli
tcagataattaacccgtcactgcgg

SEQ ID NO: 215379 - DNA, 25 bp, E. coli
ccttcatcggacagtaaattgcgga

SEQ ID NO: 215380 - DNA, 25 bp, E. coli
ccttcatcggactgtaaattgcgga

SEQ ID NO: 215381 - DNA, 25 bp, E. coli
gatatcttgtataacaccccaggag

SEQ ID NO: 215382 - DNA, 25 bp, E. coli
gatatcttgtattacaccccaggag

SEQ ID NO: 215383 - DNA, 25 bp, E. coli
taaggcgtgcctccagtgtaatcca

SEQ ID NO: 215384 - DNA, 25 bp, E. coli
taaggcgtgcctgcagtgtaatcca

SEQ ID NO: 215385 - DNA, 25 bp, E. coli
atacacatattgtcccgccggcgat

SEQ ID NO: 215386 - DNA, 25 bp, E. coli
atacacatattgacccgccggcgat

SEQ ID NO: 215387 - DNA, 25 bp, E. coli
tatccgccgcagcataagtgctgga

SEQ ID NO: 215388 - DNA, 25 bp, E. coli
tagatattgtagatgccttcggcgg

SEQ ID NO: 215389 - DNA, 25 bp, E. coli
tatccgccgcaggataagtgctgga

SEQ ID NO: 215390 - DNA, 25 bp, E. coli
tagatattgtagttgccttcggcgg

SEQ ID NO: 215391 - DNA, 25 bp, E. coli
tatcactgccgggttgagcggtctg

SEQ ID NO: 215392 - DNA, 25 bp, E. coli
tatcactgccggcttgagcggtctg

SEQ ID NO: 215393 - DNA, 25 bp, E. coli
gaaaaccggagctgggaattcgtca

SEQ ID NO: 215394 - DNA, 25 bp, E. coli
gaaaaccggagcagggaattcgtca

SEQ ID NO: 215395 - DNA, 25 bp, E. coli
ccgtttggactgattggcccgcaca

SEQ ID NO: 215396 - DNA, 25 bp, E. coli
cgtatgcagcgaagaaaggcaagct

SEQ ID NO: 215397 - DNA, 25 bp, E. coli
ccgtttggactgtttggcccgcaca

SEQ ID NO: 215398 - DNA, 25 bp, E. coli
cgtatgcagcgatgaaaggcaagct

SEQ ID NO: 215399 - DNA, 25 bp, E. coli
gataccgtggcactaaccgtggtga

SEQ ID NO: 215400 - DNA, 25 bp, E. coli
gataccgtggcagtaaccgtggtga

SEQ ID NO: 215401 - DNA, 25 bp, E. coli
ggcaatgcttggaccgataccgtgg

SEQ ID NO: 215402 - DNA, 25 bp, E. coli
tggttatcgccaagacggtagtgca

SEQ ID NO: 215403 - DNA, 25 bp, E. coli
tggttatcgccatgacggtagtgca

SEQ ID NO: 215404 - DNA, 25 bp, E. coli
ggcaatgcttggtccgataccgtgg

SEQ ID NO: 215405 - DNA, 25 bp, E. coli
tcaatactcaggtaccggtgtcaca

SEQ ID NO: 215406 - DNA, 25 bp, E. coli
tcaatactcaggaaccggtgtcaca

SEQ ID NO: 215407 - DNA, 25 bp, E. coli
tagtctttgccaccttgcttagcgt

SEQ ID NO: 215408 - DNA, 25 bp, E. coli
tagtctttgccagcttgcttagcgt

SEQ ID NO: 215409 - DNA, 25 bp, E. coli
attagtctttgcgagcttgcttagc

SEQ ID NO: 215410 - DNA, 25 bp, E. coli
agcttgcttagcgttgccgggcagt

SEQ ID NO: 215411 - DNA, 25 bp, E. coli
attagtctttgccagcttgcttagc

SEQ ID NO: 215412 - DNA, 25 bp, E. coli
agcttgcttagccttgccgggcagt

SEQ ID NO: 215413 - DNA, 25 bp, E. coli
acattagtctttcccagcttgctta

SEQ ID NO: 215414 - DNA, 25 bp, E. coli
acattagtctttgccagcttgctta

SEQ ID NO: 215415 - DNA, 25 bp, E. coli
tttgccagcttgcttagcgttgccg

SEQ ID NO: 215416 - DNA, 25 bp, E. coli
ttagtctttgccagcttgcttagcg

SEQ ID NO: 215417 - DNA, 25 bp, E. coli
tttgccagcttggttagcgttgccg

SEQ ID NO: 215418 - DNA, 25 bp, E. coli
ttagtctttgcctgcttgcttagcg

SEQ ID NO: 215419 - DNA, 25 bp, E. coli
tgccagcttgctaagcgttgccggg

SEQ ID NO: 215420 - DNA, 25 bp, E. coli
tgccagcttgcttagcgttgccggg

SEQ ID NO: 215421 - DNA, 25 bp, E. coli
tctttgccagcttgcttagcgttgc

SEQ ID NO: 215422 - DNA, 25 bp, E. coli
tctttgccagctagcttagcgttgc

SEQ ID NO: 215423 - DNA, 25 bp, E. coli
ccagcttgcttagcgttgccgggca

SEQ ID NO: 215424 - DNA, 25 bp, E. coli
ccagcttgcttaccgttgccgggca

SEQ ID NO: 215425 - DNA, 25 bp, E. coli
gcttgcttagcgatgccgggcagtt

SEQ ID NO: 215426 - DNA, 25 bp, E. coli
gcttgcttagcgttgccgggcagtt

SEQ ID NO: 215427 - DNA, 25 bp, E. coli
taacattagtctatgccagcttgct

SEQ ID NO: 215428 - DNA, 25 bp, E. coli
taacattagtctttgccagcttgct

SEQ ID NO: 215429 - DNA, 25 bp, E. coli
aagccgccgccattgggatcgcaat

SEQ ID NO: 215430 - DNA, 25 bp, E. coli
aagccgccgccaatgggatcgcaat

SEQ ID NO: 215431 - DNA, 25 bp, E. coli
agaatccattcctgtggagcgcgcg

SEQ ID NO: 215432 - DNA, 25 bp, E. coli
agaatccattccagtggagcgcgcg

SEQ ID NO: 215433 - DNA, 25 bp, E. coli
acagatgtcgcactggaaaccgccg

SEQ ID NO: 215434 - DNA, 25 bp, E. coli
acagatgtcgcagtggaaaccgccg

SEQ ID NO: 215435 - DNA, 25 bp, E. coli
tgagcgtgaagaggtggcaataaac

SEQ ID NO: 215436 - DNA, 25 bp, E. coli
tgagcgtgaagacgtggcaataaac

SEQ ID NO: 215437 - DNA, 25 bp, E. coli
tcgcaatgggcactggcacagatgt

SEQ ID NO: 215438 - DNA, 25 bp, E. coli
tcgcaatgggcagtggcacagatgt

SEQ ID NO: 215439 - DNA, 25 bp, E. coli
gcgttacggttaatgcgcaggaaat

SEQ ID NO: 215440 - DNA, 25 bp, E. coli
gcgttacggttattgcgcaggaaat

SEQ ID NO: 215441 - DNA, 25 bp, E. coli
gaaaggcgttttcctcgtcaccacg

SEQ ID NO: 215442 - DNA, 25 bp, E. coli
gaaaggcgttttgctcgtcaccacg

SEQ ID NO: 215443 - DNA, 25 bp, E. coli
cgaaccacaagattcacgcctgaaa

SEQ ID NO: 215444 - DNA, 25 bp, E. coli
cgaaccacaagaatcacgcctgaaa

SEQ ID NO: 215445 - DNA, 25 bp, E. coli
ggcgcgcgccactcacgcgaatatt

SEQ ID NO: 215446 - DNA, 25 bp, E. coli
ggcgcgcgccacacacgcgaatatt

SEQ ID NO: 215447 - DNA, 25 bp, E. coli
tggcaataaacagcctgcggcctgg

SEQ ID NO: 215448 - DNA, 25 bp, E. coli
tggcaataaacaccctgcggcctgg

SEQ ID NO: 215449 - DNA, 25 bp, E. coli
tgtgctttagttttctccacgcccg

SEQ ID NO: 215450 - DNA, 25 bp, E. coli
tgtgctttagttatctccacgcccg

SEQ ID NO: 215451 - DNA, 25 bp, E. coli
caacggtcggttactcctgattacg

SEQ ID NO: 215452 - DNA, 25 bp, E. coli
caacggtcggtttctcctgattacg

SEQ ID NO: 215453 - DNA, 25 bp, E. coli
tacttagccctgtagcgtgattttt

SEQ ID NO: 215454 - DNA, 25 bp, E. coli
tacttagccctgaagcgtgattttt

SEQ ID NO: 215455 - DNA, 25 bp, E. coli
tagcggcagagacagcgttttactt

SEQ ID NO: 215456 - DNA, 25 bp, E. coli
tagcggcagagagagcgttttactt

SEQ ID NO: 215457 - DNA, 25 bp, E. coli
tatataaacccttccatattagcgg

SEQ ID NO: 215458 - DNA, 25 bp, E. coli
tatataaaccctaccatattagcgg

SEQ ID NO: 215459 - DNA, 25 bp, E. coli
tgttgtggcatcgaacggtcggtta

SEQ ID NO: 215460 - DNA, 25 bp, E. coli
tgttgtggcatccaacggtcggtta

SEQ ID NO: 215461 - DNA, 25 bp, E. coli
ccatattagcggcagagacagcgtt

SEQ ID NO: 215462 - DNA, 25 bp, E. coli
ccatattagcgggagagacagcgtt

SEQ ID NO: 215463 - DNA, 25 bp, E. coli
gcgttttacttacccctgaagcgtg

SEQ ID NO: 215464 - DNA, 25 bp, E. coli
gcatccaacggtgggttactcctga

SEQ ID NO: 215465 - DNA, 25 bp, E. coli
gcatccaacggtcggttactcctga

SEQ ID NO: 215466 - DNA, 25 bp, E. coli
gcgttttacttagccctgaagcgtg

SEQ ID NO: 215467 - DNA, 25 bp, E. coli
gattacgctgtctcttatataaacc

SEQ ID NO: 215468 - DNA, 25 bp, E. coli
gattacgctgtcacttatataaacc

SEQ ID NO: 215469 - DNA, 25 bp, E. coli
ggttactcctgattacgctgtctct

SEQ ID NO: 215470 - DNA, 25 bp, E. coli
ggttactcctgaatacgctgtctct

SEQ ID NO: 215471 - DNA, 25 bp, E. coli
gagacagcgttttacttagccctga

SEQ ID NO: 215472 - DNA, 25 bp, E. coli
gagacagcgtttaacttagccctga

SEQ ID NO: 215473 - DNA, 25 bp, E. coli
caatattgttgatgccgtggtcggg

SEQ ID NO: 215474 - DNA, 25 bp, E. coli
caatattgttgaagccgtggtcggg

SEQ ID NO: 215475 - DNA, 25 bp, E. coli
taaattgctgccgtggtataacccc

SEQ ID NO: 215476 - DNA, 25 bp, E. coli
taaattgctgccctggtataacccc

SEQ ID NO: 215477 - DNA, 25 bp, E. coli
actggctgcgtcaggcactcggcag

SEQ ID NO: 215478 - DNA, 25 bp, E. coli
actggctgcgtctggcactcggcag

SEQ ID NO: 215479 - DNA, 25 bp, E. coli
tataaccccttggaaaatctggctg

SEQ ID NO: 215480 - DNA, 25 bp, E. coli
tataaccccttgcaaaatctggctg

SEQ ID NO: 215481 - DNA, 25 bp, E. coli
ttctggttgtcctgctgacgcccgg

SEQ ID NO: 215482 - DNA, 25 bp, E. coli
ttctggttgtccagctgacgcccgg

SEQ ID NO: 215483 - DNA, 25 bp, E. coli
tgagctttcgcactttggcacccaa

SEQ ID NO: 215484 - DNA, 25 bp, E. coli
tgagctttcgcagtttggcacccaa

SEQ ID NO: 215485 - DNA, 25 bp, E. coli
tcgctgggaaatatcgccgcatcca

SEQ ID NO: 215486 - DNA, 25 bp, E. coli
tcgctgggaaatttcgccgcatcca

SEQ ID NO: 215487 - DNA, 25 bp, E. coli
gcgttttatcgccatgccgggcgca

SEQ ID NO: 215488 - DNA, 25 bp, E. coli
gcgttttatcgcgatgccgggcgca

SEQ ID NO: 215489 - DNA, 25 bp, E. coli
gcatgtattaattgccctgccccac

SEQ ID NO: 215490 - DNA, 25 bp, E. coli
gcatgtattaatagccctgccccac

SEQ ID NO: 215491 - DNA, 25 bp, E. coli
ggtactgtcagattccatcggcgct

SEQ ID NO: 215492 - DNA, 25 bp, E. coli
ggtactgtcagaatccatcggcgct

SEQ ID NO: 215493 - DNA, 25 bp, E. coli
ggcagtgctgcttcgtaaattgctg

SEQ ID NO: 215494 - DNA, 25 bp, E. coli
ggcagtgctgctacgtaaattgctg

SEQ ID NO: 215495 - DNA, 25 bp, E. coli
cacccactgccgttgtggcgaagat

SEQ ID NO: 215496 - DNA, 25 bp, E. coli
cacccactgccgatgtggcgaagat

SEQ ID NO: 215497 - DNA, 25 bp, E. coli
tacgaggcggcgttgaaagccaata

SEQ ID NO: 215498 - DNA, 25 bp, E. coli
tacgaggcggcgatgaaagccaata

SEQ ID NO: 215499 - DNA, 25 bp, E. coli
tatgacaaatctcccgccgatcttg

SEQ ID NO: 215500 - DNA, 25 bp, E. coli
tatgacaaatctgccgccgatcttg

SEQ ID NO: 215501 - DNA, 25 bp, E. coli
tgccgccgatcttgcctggcaaagg

SEQ ID NO: 215502 - DNA, 25 bp, E. coli
tccgcaagcgacaggcaaagtgggt

SEQ ID NO: 215503 - DNA, 25 bp, E. coli
tgccgccgatctagcctggcaaagg

SEQ ID NO: 215504 - DNA, 25 bp, E. coli
tccgcaagcgactggcaaagtgggt

SEQ ID NO: 215505 - DNA, 25 bp, E. coli
tccacgccccgtaatgacaaatctg

SEQ ID NO: 215506 - DNA, 25 bp, E. coli
tccacgccccgttatgacaaatctg

SEQ ID NO: 215507 - DNA, 25 bp, E. coli
gaatgatttctttgccgcaattgag

SEQ ID NO: 215508 - DNA, 25 bp, E. coli
gaatgatttcttagccgcaattgag

SEQ ID NO: 215509 - DNA, 25 bp, E. coli
gaaatggttcgataaatatctctcc

SEQ ID NO: 215510 - DNA, 25 bp, E. coli
gaaatggttcgaaaaatatctctcc

SEQ ID NO: 215511 - DNA, 25 bp, E. coli
gattccataatgattccacgccccg

SEQ ID NO: 215512 - DNA, 25 bp, E. coli
gattccataatgtttccacgccccg

SEQ ID NO: 215513 - DNA, 25 bp, E. coli
tggcgaagattgtagcgcctttact

SEQ ID NO: 215514 - DNA, 25 bp, E. coli
tggcgaagattgaagcgcctttact

SEQ ID NO: 215515 - DNA, 25 bp, E. coli
gagtttatgcaacgctatccgcaag

SEQ ID NO: 215516 - DNA, 25 bp, E. coli
gagtttatgcaaggctatccgcaag

SEQ ID NO: 215517 - DNA, 25 bp, E. coli
caataactctattgcgtccagccat

SEQ ID NO: 215518 - DNA, 25 bp, E. coli
caataactctatagcgtccagccat

SEQ ID NO: 215519 - DNA, 25 bp, E. coli
caaagtgaagtactttgtgccgatt

SEQ ID NO: 215520 - DNA, 25 bp, E. coli
caaagtgaagtagtttgtgccgatt

SEQ ID NO: 215521 - DNA, 25 bp, E. coli
taccgtttcaaactgaagtactttg

SEQ ID NO: 215522 - DNA, 25 bp, E. coli
taccgtttcaaagtgaagtactttg

SEQ ID NO: 215523 - DNA, 25 bp, E. coli
taccgacatcgatactggtctgccg

SEQ ID NO: 215524 - DNA, 25 bp, E. coli
taccgacatcgaaactggtctgccg

SEQ ID NO: 215525 - DNA, 25 bp, E. coli
tattaaaacacgtaccaataactct

SEQ ID NO: 215526 - DNA, 25 bp, E. coli
tattaaaacacgaaccaataactct

SEQ ID NO: 215527 - DNA, 25 bp, E. coli
tgacagcggttatgcgaacaacggt

SEQ ID NO: 215528 - DNA, 25 bp, E. coli
tgacagcggttaagcgaacaacggt

SEQ ID NO: 215529 - DNA, 25 bp, E. coli
tgcgaacaacggtattaaaacacgt

SEQ ID NO: 215530 - DNA, 25 bp, E. coli
tgcgaacaacggaattaaaacacgt

SEQ ID NO: 215531 - DNA, 25 bp, E. coli
tccgacctgggcgatgacagcggtt

SEQ ID NO: 215532 - DNA, 25 bp, E. coli
tccgacctgggccatgacagcggtt

SEQ ID NO: 215533 - DNA, 25 bp, E. coli
tctgggtaccgacatcgatactggt

SEQ ID NO: 215534 - DNA, 25 bp, E. coli
tctgggtaccgagatcgatactggt

SEQ ID NO: 215535 - DNA, 25 bp, E. coli
ccgttactggcaaaacggtggtcag

SEQ ID NO: 215536 - DNA, 25 bp, E. coli
ccgttactggcataacggtggtcag

SEQ ID NO: 215537 - DNA, 25 bp, E. coli
ctgtcgttgcccgttactggcataa

SEQ ID NO: 215538 - DNA, 25 bp, E. coli
ctgtcgttgccccttactggcataa

SEQ ID NO: 215539 - DNA, 25 bp, E. coli
caagcgtgaaaaaccggtgctgatt

SEQ ID NO: 215540 - DNA, 25 bp, E. coli
caagcgtgaaaatccggtgctgatt

SEQ ID NO: 215541 - DNA, 25 bp, E. coli
atcagtcctggcgacctggatattg

SEQ ID NO: 215542 - DNA, 25 bp, E. coli
atcagtcctggccacctggatattg

SEQ ID NO: 215543 - DNA, 25 bp, E. coli
actcaagcgtgataatccggtgctg

SEQ ID NO: 215544 - DNA, 25 bp, E. coli
actcaagcgtgaaaatccggtgctg

SEQ ID NO: 215545 - DNA, 25 bp, E. coli
tctttccttccggaggaacgcgaat

SEQ ID NO: 215546 - DNA, 25 bp, E. coli
tctttccttccgcaggaacgcgaat

SEQ ID NO: 215547 - DNA, 25 bp, E. coli
tgaatatcagtcctggcgacctgga

SEQ ID NO: 215548 - DNA, 25 bp, E. coli
tgaatatcagtcgtggcgacctgga

SEQ ID NO: 215549 - DNA, 25 bp, E. coli
gccgctgggcaatgtcaccgtgatc

SEQ ID NO: 215550 - DNA, 25 bp, E. coli
gccgctgggcaaagtcaccgtgatc

SEQ ID NO: 215551 - DNA, 25 bp, E. coli
ccttccggaggaacgcgaatggatg

SEQ ID NO: 215552 - DNA, 25 bp, E. coli
ccttccggaggatcgcgaatggatg

SEQ ID NO: 215553 - DNA, 25 bp, E. coli
gcggaaatcccctcgccgctgggca

SEQ ID NO: 215554 - DNA, 25 bp, E. coli
gcggaaatccccacgccgctgggca

SEQ ID NO: 215555 - DNA, 25 bp, E. coli
cgaactcaagcgtgaaaatccggtg

SEQ ID NO: 215556 - DNA, 25 bp, E. coli
cgaactcaagcgagaaaatccggtg

SEQ ID NO: 215557 - DNA, 25 bp, E. coli
gatatgaatatctgtcctggcgacc

SEQ ID NO: 215558 - DNA, 25 bp, E. coli
gatatgaatatcagtcctggcgacc

SEQ ID NO: 215559 - DNA, 25 bp, E. coli
tgttctttccttccggaggaacgcg

SEQ ID NO: 215560 - DNA, 25 bp, E. coli
tgttctttccttgcggaggaacgcg

SEQ ID NO: 215561 - DNA, 25 bp, E. coli
cagtcagaaatcactcagcaagagt

SEQ ID NO: 215562 - DNA, 25 bp, E. coli
cagtcagaaatctctcagcaagagt

SEQ ID NO: 215563 - DNA, 25 bp, E. coli
agaaatcactcagcaagagttagcc

SEQ ID NO: 215564 - DNA, 25 bp, E. coli
agaaatcactcaccaagagttagcc

SEQ ID NO: 215565 - DNA, 25 bp, E. coli
aaagagttatcgctggtgatggttt

SEQ ID NO: 215566 - DNA, 25 bp, E. coli
aaagagttatcggtggtgatggttt

SEQ ID NO: 215567 - DNA, 25 bp, E. coli
ttgagcgtcgcctctaaggtattgc

SEQ ID NO: 215568 - DNA, 25 bp, E. coli
tttttacagtcacaaatcactcagc

SEQ ID NO: 215569 - DNA, 25 bp, E. coli
tttttacagtcagaaatcactcagc

SEQ ID NO: 215570 - DNA, 25 bp, E. coli
ttgagcgtcgccactaaggtattgc

SEQ ID NO: 215571 - DNA, 25 bp, E. coli
tgttaaatgcttatttacagtcaga

SEQ ID NO: 215572 - DNA, 25 bp, E. coli
tgttaaatgcttttttacagtcaga

SEQ ID NO: 215573 - DNA, 25 bp, E. coli
tcgcctctaaggtattgctgttaaa

SEQ ID NO: 215574 - DNA, 25 bp, E. coli
tcgcctctaaggaattgctgttaaa

SEQ ID NO: 215575 - DNA, 25 bp, E. coli
cctctaaggtatagctgttaaatgc

SEQ ID NO: 215576 - DNA, 25 bp, E. coli
cctctaaggtattgctgttaaatgc

SEQ ID NO: 215577 - DNA, 25 bp, E. coli
cgcttggcaaagtgttatcgctggt

SEQ ID NO: 215578 - DNA, 25 bp, E. coli
cgcttggcaaagagttatcgctggt

SEQ ID NO: 215579 - DNA, 25 bp, E. coli
tggcaaagagttatcgctggtgatg

SEQ ID NO: 215580 - DNA, 25 bp, E. coli
tggcaaagagttttcgctggtgatg

SEQ ID NO: 215581 - DNA, 25 bp, E. coli
gagcgtcgcctcaaaggtattgctg

SEQ ID NO: 215582 - DNA, 25 bp, E. coli
gagcgtcgcctctaaggtattgctg

SEQ ID NO: 215583 - DNA, 25 bp, E. coli
catttagtccggttgatgtgcaggg

SEQ ID NO: 215584 - DNA, 25 bp, E. coli
acctgcaatgggacggcatggcacc

SEQ ID NO: 215585 - DNA, 25 bp, E. coli
acctgcaatgggtcggcatggcacc

SEQ ID NO: 215586 - DNA, 25 bp, E. coli
tagaaattcccaatgatgcgccggg

SEQ ID NO: 215587 - DNA, 25 bp, E. coli
tagaaattcccattgatgcgccggg

SEQ ID NO: 215588 - DNA, 25 bp, E. coli
tcattcgaaagtcatgcggaagcga

SEQ ID NO: 215589 - DNA, 25 bp, E. coli
tcattcgaaagtgatgcggaagcga

SEQ ID NO: 215590 - DNA, 25 bp, E. coli
gccttccaggtacatcgtttagcgg

SEQ ID NO: 215591 - DNA, 25 bp, E. coli
gccttccaggtagatcgtttagcgg

SEQ ID NO: 215592 - DNA, 25 bp, E. coli
gcttaatgagttcggctatgccgca

SEQ ID NO: 215593 - DNA, 25 bp, E. coli
gcttaatgagttgggctatgccgca

SEQ ID NO: 215594 - DNA, 25 bp, E. coli
gaagcgaagctgcttcacgatctgc

SEQ ID NO: 215595 - DNA, 25 bp, E. coli
gaagcgaagctggttcacgatctgc

SEQ ID NO: 215596 - DNA, 25 bp, E. coli
gacgaaggtcaggtcattggctatg

SEQ ID NO: 215597 - DNA, 25 bp, E. coli
gacgaaggtcagctcattggctatg

SEQ ID NO: 215598 - DNA, 25 bp, E. coli
cgtgaagatggctttctgacgctgg

SEQ ID NO: 215599 - DNA, 25 bp, E. coli
catttagtccggatgatgtgcaggg

SEQ ID NO: 215600 - DNA, 25 bp, E. coli
cgtgaagatggcattctgacgctgg

SEQ ID NO: 215601 - DNA, 25 bp, E. coli
tggtctatgaagcactcgattcgct

SEQ ID NO: 215602 - DNA, 25 bp, E. coli
tggtctatgaaggactcgattcgct

SEQ ID NO: 215603 - DNA, 25 bp, E. coli
ggctggcacgcctactggtctatga

SEQ ID NO: 215604 - DNA, 25 bp, E. coli
ggctggcacgccaactggtctatga

SEQ ID NO: 215605 - DNA, 25 bp, E. coli
caaacgcgaaggagatgtaaagcat

SEQ ID NO: 215606 - DNA, 25 bp, E. coli
caaacgcgaaggtgatgtaaagcat

SEQ ID NO: 215607 - DNA, 25 bp, E. coli
cacgcacttactccaattttattca

SEQ ID NO: 215608 - DNA, 25 bp, E. coli
cacgcacttactgcaattttattca

SEQ ID NO: 215609 - DNA, 25 bp, E. coli
taaattgggccaatgatgtatggaa

SEQ ID NO: 215610 - DNA, 25 bp, E. coli
taaattgggccattgatgtatggaa

SEQ ID NO: 215611 - DNA, 25 bp, E. coli
taaagaaaatattcaaacgcgaagg

SEQ ID NO: 215612 - DNA, 25 bp, E. coli
taaagaaaatatacaaacgcgaagg

SEQ ID NO: 215613 - DNA, 25 bp, E. coli
acggagcaaggcctggcaccgcatt

SEQ ID NO: 215614 - DNA, 25 bp, E. coli
acggagcaaggcgtggcaccgcatt

SEQ ID NO: 215615 - DNA, 25 bp, E. coli
taatgacccagtgtaaattgggcca

SEQ ID NO: 215616 - DNA, 25 bp, E. coli
taatgacccagtctaaattgggcca

SEQ ID NO: 215617 - DNA, 25 bp, E. coli
tcttatgtctaattggaacggaacg

SEQ ID NO: 215618 - DNA, 25 bp, E. coli
tcttatgtctaaatggaacggaacg

SEQ ID NO: 215619 - DNA, 25 bp, E. coli
gcagatattatgtgtaatgacccag

SEQ ID NO: 215620 - DNA, 25 bp, E. coli
gaacggaacgctattgctcaccata

SEQ ID NO: 215621 - DNA, 25 bp, E. coli
gaacggaacgcttttgctcaccata

SEQ ID NO: 215622 - DNA, 25 bp, E. coli
gcagatattatgagtaatgacccag

SEQ ID NO: 215623 - DNA, 25 bp, E. coli
ctatttcaatagcttaatcaatggg

SEQ ID NO: 215624 - DNA, 25 bp, E. coli
ctatttcaataggttaatcaatggg

SEQ ID NO: 215625 - DNA, 25 bp, E. coli
ggcaccgcatttctgcaagtgataa

SEQ ID NO: 215626 - DNA, 25 bp, E. coli
ggcaccgcatttgtgcaagtgataa

SEQ ID NO: 215627 - DNA, 25 bp, E. coli
caaaaagcggatgagatgggcgcaa

SEQ ID NO: 215628 - DNA, 25 bp, E. coli
caaaaagcggatcagatgggcgcaa

SEQ ID NO: 215629 - DNA, 25 bp, E. coli
catttgccagctttgcggctgtcga

SEQ ID NO: 215630 - DNA, 25 bp, E. coli
catttgccagctatgcggctgtcga

SEQ ID NO: 215631 - DNA, 25 bp, E. coli
aacgtaaaaaccgtcatcgctgcgg

SEQ ID NO: 215632 - DNA, 25 bp, E. coli
aacgtaaaaaccctcatcgctgcgg

SEQ ID NO: 215633 - DNA, 25 bp, E. coli
ttcagtcaacgccagaaggccaaca

SEQ ID NO: 215634 - DNA, 25 bp, E. coli
tattacttctgttaccggtccgaat

SEQ ID NO: 215635 - DNA, 25 bp, E. coli
tattacttctgtaaccggtccgaat

SEQ ID NO: 215636 - DNA, 25 bp, E. coli
ttcagtcaacgcgagaaggccaaca

SEQ ID NO: 215637 - DNA, 25 bp, E. coli
tgcggctgtcgaagttcagtcaacg

SEQ ID NO: 215638 - DNA, 25 bp, E. coli
tgcggctgtcgatgttcagtcaacg

SEQ ID NO: 215639 - DNA, 25 bp, E. coli
gccagaaggccatcaaaaagtcggt

SEQ ID NO: 215640 - DNA, 25 bp, E. coli
gccagaaggccaacaaaaagtcggt

SEQ ID NO: 215641 - DNA, 25 bp, E. coli
ccctccatggaacagcagtaattta

SEQ ID NO: 215642 - DNA, 25 bp, E. coli
ccctccatggaagagcagtaattta

SEQ ID NO: 215643 - DNA, 25 bp, E. coli
ggtccgaataccctccatggaacag

SEQ ID NO: 215644 - DNA, 25 bp, E. coli
tgggcgcaaaatgtttccgtattac

SEQ ID NO: 215645 - DNA, 25 bp, E. coli
ggtccgaataccgtccatggaacag

SEQ ID NO: 215646 - DNA, 25 bp, E. coli
tgggcgcaaaatctttccgtattac

SEQ ID NO: 215647 - DNA, 25 bp, E. coli
tggaagagcagctggcgcaaaaagc

SEQ ID NO: 215648 - DNA, 25 bp, E. coli
tggaagagcagcaggcgcaaaaagc

SEQ ID NO: 215649 - DNA, 25 bp, E. coli
aataaaggtcttccgcacgtcaccg

SEQ ID NO: 215650 - DNA, 25 bp, E. coli
aataaaggtcttgcgcacgtcaccg

SEQ ID NO: 215651 - DNA, 25 bp, E. coli
taaaacgtcgatcaacgctggcatg

SEQ ID NO: 215652 - DNA, 25 bp, E. coli
tacagcatctgcaaagcggcgactt

SEQ ID NO: 215653 - DNA, 25 bp, E. coli
taaaacgtcgatgaacgctggcatg

SEQ ID NO: 215654 - DNA, 25 bp, E. coli
tacagcatctgctaagcggcgactt

SEQ ID NO: 215655 - DNA, 25 bp, E. coli
tacggctgggaaaatgcgatggccc

SEQ ID NO: 215656 - DNA, 25 bp, E. coli
aaagggctgctaattctcggcgcgg

SEQ ID NO: 215657 - DNA, 25 bp, E. coli
aaagggctgctatttctcggcgcgg

SEQ ID NO: 215658 - DNA, 25 bp, E. coli
tacggctgggaatatgcgatggccc

SEQ ID NO: 215659 - DNA, 25 bp, E. coli
tatcagcgaatggtacacctggcag

SEQ ID NO: 215660 - DNA, 25 bp, E. coli
tattactttctgaggtgcgccgcgc

SEQ ID NO: 215661 - DNA, 25 bp, E. coli
tatcagcgaatgctacacctggcag

SEQ ID NO: 215662 - DNA, 25 bp, E. coli
tttaaccctgcgaatggatagcctc

SEQ ID NO: 215663 - DNA, 25 bp, E. coli
tattactttctgtggtgcgccgcgc

SEQ ID NO: 215664 - DNA, 25 bp, E. coli
tttaaccctgcgtatggatagcctc

SEQ ID NO: 215665 - DNA, 25 bp, E. coli
gatatcaaacgggtgctggcctgga

SEQ ID NO: 215666 - DNA, 25 bp, E. coli
gatatcaaacggctgctggcctgga

SEQ ID NO: 215667 - DNA, 25 bp, E. coli
tcaaccatgcgctgttcaaagggct

SEQ ID NO: 215668 - DNA, 25 bp, E. coli
taagtcgtgtggtagccgtagcgct

SEQ ID NO: 215669 - DNA, 25 bp, E. coli
taagtcgtgtggaagccgtagcgct

SEQ ID NO: 215670 - DNA, 25 bp, E. coli
tcaaccatgcgcagttcaaagggct

SEQ ID NO: 215671 - DNA, 25 bp, E. coli
catgcgggcaccaaaaaagaggtct

SEQ ID NO: 215672 - DNA, 25 bp, E. coli
catgcgggcacctaaaaagaggtct

SEQ ID NO: 215673 - DNA, 25 bp, E. coli
taacgtcgatcagagctggaaagag

SEQ ID NO: 215674 - DNA, 25 bp, E. coli
tacagatgggacctgacctgacaac

SEQ ID NO: 215675 - DNA, 25 bp, E. coli
tacagatgggacgtgacctgacaac

SEQ ID NO: 215676 - DNA, 25 bp, E. coli
aaatatttcgataccgtcctggccg

SEQ ID NO: 215677 - DNA, 25 bp, E. coli
aaatatttcgattccgtcctggccg

SEQ ID NO: 215678 - DNA, 25 bp, E. coli
tgggttatgccagcgaaagacatgc

SEQ ID NO: 215679 - DNA, 25 bp, E. coli
tgggttatgccaccgaaagacatgc

SEQ ID NO: 215680 - DNA, 25 bp, E. coli
taaaacggacggaggaaggcgatct

SEQ ID NO: 215681 - DNA, 25 bp, E. coli
taaaacggacggtggaaggcgatct

SEQ ID NO: 215682 - DNA, 25 bp, E. coli
gaataacgcccgtgtgctggcagaa

SEQ ID NO: 215683 - DNA, 25 bp, E. coli
gaataacgcccgagtgctggcagaa

SEQ ID NO: 215684 - DNA, 25 bp, E. coli
ccgatgtttattccgcctgtgccaa

SEQ ID NO: 215685 - DNA, 25 bp, E. coli
ccgatgtttattgcgcctgtgccaa

SEQ ID NO: 215686 - DNA, 25 bp, E. coli
gatattctcttgatcaccggcggca

SEQ ID NO: 215687 - DNA, 25 bp, E. coli
gatattctcttgttcaccggcggca

SEQ ID NO: 215688 - DNA, 25 bp, E. coli
tggtcaaggcaaacagtaacgtcga

SEQ ID NO: 215689 - DNA, 25 bp, E. coli
tggtcaaggcaatcagtaacgtcga

SEQ ID NO: 215690 - DNA, 25 bp, E. coli
taacgtcgatcacagctggaaagag

SEQ ID NO: 215691 - DNA, 25 bp, E. coli
gatcctcgggcaaaaagacctgacc

SEQ ID NO: 215692 - DNA, 25 bp, E. coli
gatcctcgggcataaagacctgacc

SEQ ID NO: 215693 - DNA, 25 bp, E. coli
agattatgacggtgacagcggcgat

SEQ ID NO: 215694 - DNA, 25 bp, E. coli
agattatgacggagacagcggcgat

SEQ ID NO: 215695 - DNA, 25 bp, E. coli
aaaatgacgagattatgacggagac

SEQ ID NO: 215696 - DNA, 25 bp, E. coli
aaaatgacgagaatatgacggagac

SEQ ID NO: 215697 - DNA, 25 bp, E. coli
tatgacggagactgcggcgattgca

SEQ ID NO: 215698 - DNA, 25 bp, E. coli
tatgacggagacagcggcgattgca

SEQ ID NO: 215699 - DNA, 25 bp, E. coli
ttgatggttctcgatcgtcgcccgg

SEQ ID NO: 215700 - DNA, 25 bp, E. coli
ttatgcgtttggagagcaactaacg

SEQ ID NO: 215701 - DNA, 25 bp, E. coli
ttatgcgtttggtgagcaactaacg

SEQ ID NO: 215702 - DNA, 25 bp, E. coli
ttgatggttctccatcgtcgcccgg

SEQ ID NO: 215703 - DNA, 25 bp, E. coli
tgcactatgcgctcatgggggcctg

SEQ ID NO: 215704 - DNA, 25 bp, E. coli
tgcactatgcgcacatgggggcctg

SEQ ID NO: 215705 - DNA, 25 bp, E. coli
tcaggataatgcgacgaatatcagt

SEQ ID NO: 215706 - DNA, 25 bp, E. coli
tcaggataatgccacgaatatcagt

SEQ ID NO: 215707 - DNA, 25 bp, E. coli
gccacgaatatctgtgcgattgctg

SEQ ID NO: 215708 - DNA, 25 bp, E. coli
gccacgaatatcagtgcgattgctg

SEQ ID NO: 215709 - DNA, 25 bp, E. coli
gttctcgatcgtggcccggaccttg

SEQ ID NO: 215710 - DNA, 25 bp, E. coli
gttctcgatcgtcgcccggaccttg

SEQ ID NO: 215711 - DNA, 25 bp, E. coli
gaaccttatgcgtttggtgagcaac

SEQ ID NO: 215712 - DNA, 25 bp, E. coli
gaaccttatgcgattggtgagcaac

SEQ ID NO: 215713 - DNA, 25 bp, E. coli
gattgcattgatcgttctcgatcgt

SEQ ID NO: 215714 - DNA, 25 bp, E. coli
gattgcattgatggttctcgatcgt

SEQ ID NO: 215715 - DNA, 25 bp, E. coli
taaactgcagcaatatcgcgaaatg

SEQ ID NO: 215716 - DNA, 25 bp, E. coli
taaactgcagcattatcgcgaaatg

SEQ ID NO: 215717 - DNA, 25 bp, E. coli
aacatccgtactgttcgtgcgcagg

SEQ ID NO: 215718 - DNA, 25 bp, E. coli
aacatccgtactcttcgtgcgcagg

SEQ ID NO: 215719 - DNA, 25 bp, E. coli
tatagctacgttgacgaaaacggcg

SEQ ID NO: 215720 - DNA, 25 bp, E. coli
tatagctacgttcacgaaaacggcg

SEQ ID NO: 215721 - DNA, 25 bp, E. coli
tgagcaaggtaattccctcgacgat

SEQ ID NO: 215722 - DNA, 25 bp, E. coli
tgagcaaggtaaatccctcgacgat

SEQ ID NO: 215723 - DNA, 25 bp, E. coli
tgctgaagttgaagagcgcactcgt

SEQ ID NO: 215724 - DNA, 25 bp, E. coli
tcgcgaagaagaaagcgcggctgct

SEQ ID NO: 215725 - DNA, 25 bp, E. coli
tcgcgaagaagatagcgcggctgct

SEQ ID NO: 215726 - DNA, 25 bp, E. coli
tgctgaagttgatgagcgcactcgt

SEQ ID NO: 215727 - DNA, 25 bp, E. coli
tcgtgcgcaggcaagagaatgtaca

SEQ ID NO: 215728 - DNA, 25 bp, E. coli
tcgtgcgcaggctagagaatgtaca

SEQ ID NO: 215729 - DNA, 25 bp, E. coli
cgtgctcagcgtgcggcaaaatata

SEQ ID NO: 215730 - DNA, 25 bp, E. coli
cgtgctcagcgtccggcaaaatata

SEQ ID NO: 215731 - DNA, 25 bp, E. coli
ggccgtactccagctgtaatcaaaa

SEQ ID NO: 215732 - DNA, 25 bp, E. coli
ggccgtactccacctgtaatcaaaa

SEQ ID NO: 215733 - DNA, 25 bp, E. coli
gatcgctgacggtattgacccgaac

SEQ ID NO: 215734 - DNA, 25 bp, E. coli
gatcgctgacggaattgacccgaac

SEQ ID NO: 215735 - DNA, 25 bp, E. coli
gagaatgtacacttgaaacgctgga

SEQ ID NO: 215736 - DNA, 25 bp, E. coli
gagaatgtacacatgaaacgctgga

SEQ ID NO: 215737 - DNA, 25 bp, E. coli
aaggtgctccaggtattggcgttcc

SEQ ID NO: 215738 - DNA, 25 bp, E. coli
cactgattatccagtgctggcgaaa

SEQ ID NO: 215739 - DNA, 25 bp, E. coli
cactgattatcctgtgctggcgaaa

SEQ ID NO: 215740 - DNA, 25 bp, E. coli
catttaactttctggtgagggctaa

SEQ ID NO: 215741 - DNA, 25 bp, E. coli
taactttcatgaaggcatcgccgga

SEQ ID NO: 215742 - DNA, 25 bp, E. coli
aaggtgctccagctattggcgttcc

SEQ ID NO: 215743 - DNA, 25 bp, E. coli
tggtattacctgtagcccgcggtga

SEQ ID NO: 215744 - DNA, 25 bp, E. coli
tcgcgaattatttagctggcaggca

SEQ ID NO: 215745 - DNA, 25 bp, E. coli
tcgcgaattattaagctggcaggca

SEQ ID NO: 215746 - DNA, 25 bp, E. coli
tcattcgtatctgggatgacgggcg

SEQ ID NO: 215747 - DNA, 25 bp, E. coli
tcattcgtatctcggatgacgggcg

SEQ ID NO: 215748 - DNA, 25 bp, E. coli
gcatcgccggaattcagccaggatt

SEQ ID NO: 215749 - DNA, 25 bp, E. coli
gcgggacacgcaattaactttcatg

SEQ ID NO: 215750 - DNA, 25 bp, E. coli
gcgggacacgcatttaactttcatg

SEQ ID NO: 215751 - DNA, 25 bp, E. coli
gcatcgccggaaatcagccaggatt

SEQ ID NO: 215752 - DNA, 25 bp, E. coli
gaattttgttgcagtcagaccgcga

SEQ ID NO: 215753 - DNA, 25 bp, E. coli
gaattttgttgctgtcagaccgcga

SEQ ID NO: 215754 - DNA, 25 bp, E. coli
catttaactttcaggtgagggctaa

SEQ ID NO: 215755 - DNA, 25 bp, E. coli
tggtattacctgaagcccgcggtga

SEQ ID NO: 215756 - DNA, 25 bp, E. coli
tggcaggcagctacaaacttttctc

SEQ ID NO: 215757 - DNA, 25 bp, E. coli
tggcaggcagcttcaaacttttctc

SEQ ID NO: 215758 - DNA, 25 bp, E. coli
taactttcatgatggcatcgccgga

SEQ ID NO: 215759 - DNA, 25 bp, E. coli
caatgcgcgtgaacgcaattgcggt

SEQ ID NO: 215760 - DNA, 25 bp, E. coli
caatgcgcgtgatcgcaattgcggt

SEQ ID NO: 215761 - DNA, 25 bp, E. coli
caattgcggtggtaacggatgccat

SEQ ID NO: 215762 - DNA, 25 bp, E. coli
caattgcggtggaaacggatgccat

SEQ ID NO: 215763 - DNA, 25 bp, E. coli
caggtctttgcgctggctcagtcga

SEQ ID NO: 215764 - DNA, 25 bp, E. coli
cagtcgattcatcttggcaatacgc

SEQ ID NO: 215765 - DNA, 25 bp, E. coli
cagtcgattcatgttggcaatacgc

SEQ ID NO: 215766 - DNA, 25 bp, E. coli
caggtctttgcggtggctcagtcga

SEQ ID NO: 215767 - DNA, 25 bp, E. coli
tacgacctgggtctgctgacagaac

SEQ ID NO: 215768 - DNA, 25 bp, E. coli
aacggatgccatcatcgaagcgggc

SEQ ID NO: 215769 - DNA, 25 bp, E. coli
aacggatgccatgatcgaagcgggc

SEQ ID NO: 215770 - DNA, 25 bp, E. coli
tacgacctgggtgtgctgacagaac

SEQ ID NO: 215771 - DNA, 25 bp, E. coli
tttatcgacatgcaacaggcgttct

SEQ ID NO: 215772 - DNA, 25 bp, E. coli
ttatcgtggtgttcatctccagcca

SEQ ID NO: 215773 - DNA, 25 bp, E. coli
ttatcgtggtgtacatctccagcca

SEQ ID NO: 215774 - DNA, 25 bp, E. coli
tttatcgacatggaacaggcgttct

SEQ ID NO: 215775 - DNA, 25 bp, E. coli
tctgccagcggctcgattaaccgtg

SEQ ID NO: 215776 - DNA, 25 bp, E. coli
tctgccagcggcacgattaaccgtg

SEQ ID NO: 215777 - DNA, 25 bp, E. coli
gaagcgggcccgcatatcctgttgc

SEQ ID NO: 215778 - DNA, 25 bp, E. coli
gaagcgggcccggatatcctgttgc

SEQ ID NO: 215779 - DNA, 25 bp, E. coli
gatcatctgcgagcaaaatcgctgg

SEQ ID NO: 215780 - DNA, 25 bp, E. coli
gatcatctgcgaccaaaatcgctgg

SEQ ID NO: 215781 - DNA, 25 bp, E. coli
catggcgcgaacattgacgaagcaa

SEQ ID NO: 215782 - DNA, 25 bp, E. coli
catggcgcgaactttgacgaagcaa

SEQ ID NO: 215783 - DNA, 25 bp, E. coli
atgatggcagactcacaacccctgt

SEQ ID NO: 215784 - DNA, 25 bp, E. coli
atgatggcagacacacaacccctgt

SEQ ID NO: 215785 - DNA, 25 bp, E. coli
ttcgaccacccgttggtgatcgctg

SEQ ID NO: 215786 - DNA, 25 bp, E. coli
tatttaagagcgctactacgtgcac

SEQ ID NO: 215787 - DNA, 25 bp, E. coli
tatcaaagttgatgcggtacgcggc

SEQ ID NO: 215788 - DNA, 25 bp, E. coli
ttcgaccacccgatggtgatcgctg

SEQ ID NO: 215789 - DNA, 25 bp, E. coli
tatcaaagttgaagcggtacgcggc

SEQ ID NO: 215790 - DNA, 25 bp, E. coli
tatttaagagcggtactacgtgcac

SEQ ID NO: 215791 - DNA, 25 bp, E. coli
tgatcactgcctcggcgggtaatca

SEQ ID NO: 215792 - DNA, 25 bp, E. coli
tgatcactgcctgggcgggtaatca

SEQ ID NO: 215793 - DNA, 25 bp, E. coli
tgacgaagcaaatgcgaaagcgatc

SEQ ID NO: 215794 - DNA, 25 bp, E. coli
tgacgaagcaaaagcgaaagcgatc

SEQ ID NO: 215795 - DNA, 25 bp, E. coli
ccatcccggaagagaagggcagctt

SEQ ID NO: 215796 - DNA, 25 bp, E. coli
ccagcataatattcgcggcgaacgc

SEQ ID NO: 215797 - DNA, 25 bp, E. coli
ccagcataatatacgcggcgaacgc

SEQ ID NO: 215798 - DNA, 25 bp, E. coli
ccatcccggaagtgaagggcagctt

SEQ ID NO: 215799 - DNA, 25 bp, E. coli
cgaagtgttgcttcatggcgcgaac

SEQ ID NO: 215800 - DNA, 25 bp, E. coli
cgaagtgttgctacatggcgcgaac

SEQ ID NO: 215801 - DNA, 25 bp, E. coli
gatgcccatcttgaccgcgtgtttg

SEQ ID NO: 215802 - DNA, 25 bp, E. coli
gatgcccatcttcaccgcgtgtttg

SEQ ID NO: 215803 - DNA, 25 bp, E. coli
caatatatcgaatgcggtagtcggc

SEQ ID NO: 215804 - DNA, 25 bp, E. coli
caatatatcgaaagcggtagtcggc

SEQ ID NO: 215805 - DNA, 25 bp, E. coli
cactatatttgccactgagctggtc

SEQ ID NO: 215806 - DNA, 25 bp, E. coli
cactatatttgcgactgagctggtc

SEQ ID NO: 215807 - DNA, 25 bp, E. coli
tagtcggcggctgtaagtatgtaat

SEQ ID NO: 215808 - DNA, 25 bp, E. coli
aaaaagcctgagatcgatgagggac

SEQ ID NO: 215809 - DNA, 25 bp, E. coli
aaaaagcctgagttcgatgagggac

SEQ ID NO: 215810 - DNA, 25 bp, E. coli
tatgtaatgatgttgctgcactggt

SEQ ID NO: 215811 - DNA, 25 bp, E. coli
tatgtaatgatgatgctgcactggt

SEQ ID NO: 215812 - DNA, 25 bp, E. coli
tagtcggcggctctaagtatgtaat

SEQ ID NO: 215813 - DNA, 25 bp, E. coli
tcgatgagggacgaactcaggctag

SEQ ID NO: 215814 - DNA, 25 bp, E. coli
tcgatgagggaccaactcaggctag

SEQ ID NO: 215815 - DNA, 25 bp, E. coli
gttttacagtaagacgccgcagcga

SEQ ID NO: 215816 - DNA, 25 bp, E. coli
gttttacagtaacacgccgcagcga

SEQ ID NO: 215817 - DNA, 25 bp, E. coli
ggtgctgtatcgttatgcttcggca

SEQ ID NO: 215818 - DNA, 25 bp, E. coli
gtcgctattttttaccaggctggaa

SEQ ID NO: 215819 - DNA, 25 bp, E. coli
gtcgctatttttaaccaggctggaa

SEQ ID NO: 215820 - DNA, 25 bp, E. coli
ggtgctgtatcgatatgcttcggca

SEQ ID NO: 215821 - DNA, 25 bp, E. coli
taaccaggctggaaaattgagtcaa

SEQ ID NO: 215822 - DNA, 25 bp, E. coli
taaccaggctggtaaattgagtcaa

SEQ ID NO: 215823 - DNA, 25 bp, E. coli
gatgaaatgccaataaaaaagcctg

SEQ ID NO: 215824 - DNA, 25 bp, E. coli
gatgaaatgccattaaaaaagcctg

SEQ ID NO: 215825 - DNA, 25 bp, E. coli
tttacaacagcatgaagcggtagcg

SEQ ID NO: 215826 - DNA, 25 bp, E. coli
tttacaacagcaagaagcggtagcg

SEQ ID NO: 215827 - DNA, 25 bp, E. coli
tgactgccgcgcaaagcaaagagct

SEQ ID NO: 215828 - DNA, 25 bp, E. coli
tgactgccgcgctaagcaaagagct

SEQ ID NO: 215829 - DNA, 25 bp, E. coli
tcatcagcaatgtctggcctggcgt

SEQ ID NO: 215830 - DNA, 25 bp, E. coli
tcatcagcaatgactggcctggcgt

SEQ ID NO: 215831 - DNA, 25 bp, E. coli
gccagtcgcacaatacagcggtcat

SEQ ID NO: 215832 - DNA, 25 bp, E. coli
cctggcgtgataacgaacagtggct

SEQ ID NO: 215833 - DNA, 25 bp, E. coli
cctggcgtgatatcgaacagtggct

SEQ ID NO: 215834 - DNA, 25 bp, E. coli
gccagtcgcacattacagcggtcat

SEQ ID NO: 215835 - DNA, 25 bp, E. coli
gcaaagagctggcaacgctgcttac

SEQ ID NO: 215836 - DNA, 25 bp, E. coli
gcaaagagctgggaacgctgcttac

SEQ ID NO: 215837 - DNA, 25 bp, E. coli
gacattatcaaagatgggcggattg

SEQ ID NO: 215838 - DNA, 25 bp, E. coli
gacattatcaaacatgggcggattg

SEQ ID NO: 215839 - DNA, 25 bp, E. coli
cgattacagcgaagactcactcagt

SEQ ID NO: 215840 - DNA, 25 bp, E. coli
cgattacagcgatgactcactcagt

SEQ ID NO: 215841 - DNA, 25 bp, E. coli
ctggatatggatgcggactccctgc

SEQ ID NO: 215842 - DNA, 25 bp, E. coli
ctggatatggatccggactccctgc

SEQ ID NO: 215843 - DNA, 25 bp, E. coli
ggactccctgcgcttcgattacagc

SEQ ID NO: 215844 - DNA, 25 bp, E. coli
ggactccctgcggttcgattacagc

SEQ ID NO: 215845 - DNA, 25 bp, E. coli
gatgccagtgcattacagcgattcc

SEQ ID NO: 215846 - DNA, 25 bp, E. coli
gatgccagtgcaatacagcgattcc

SEQ ID NO: 215847 - DNA, 25 bp, E. coli
aagatattttctataactactgcaa

SEQ ID NO: 215848 - DNA, 25 bp, E. coli
aagatattttctttaactactgcaa

SEQ ID NO: 215849 - DNA, 25 bp, E. coli
catgacgaagcaaaagatattttct

SEQ ID NO: 215850 - DNA, 25 bp, E. coli
catgacgaagcataagatattttct

SEQ ID NO: 215851 - DNA, 25 bp, E. coli
tactgcaattacacatatcacgaaa

SEQ ID NO: 215852 - DNA, 25 bp, E. coli
tactgcaattactcatatcacgaaa

SEQ ID NO: 215853 - DNA, 25 bp, E. coli
tacatgacgaaggaaaagatatttt

SEQ ID NO: 215854 - DNA, 25 bp, E. coli
tactcatatcacgaaataaaagacg

SEQ ID NO: 215855 - DNA, 25 bp, E. coli
tactcatatcaccaaataaaagacg

SEQ ID NO: 215856 - DNA, 25 bp, E. coli
tacatgacgaagcaaaagatatttt

SEQ ID NO: 215857 - DNA, 25 bp, E. coli
aactactgcaattactcatatcacg

SEQ ID NO: 215858 - DNA, 25 bp, E. coli
cacgaaataaaacacgaagaggaag

SEQ ID NO: 215859 - DNA, 25 bp, E. coli
aactactgcaataactcatatcacg

SEQ ID NO: 215860 - DNA, 25 bp, E. coli
cacgaaataaaagacgaagaggaag

SEQ ID NO: 215861 - DNA, 25 bp, E. coli
tatcacgaaataaaagacgaagagg

SEQ ID NO: 215862 - DNA, 25 bp, E. coli
tatcacgaaatataagacgaagagg

SEQ ID NO: 215863 - DNA, 25 bp, E. coli
cctgatgaaatagatgacgaagcaa

SEQ ID NO: 215864 - DNA, 25 bp, E. coli
cctgatgaaatacatgacgaagcaa

SEQ ID NO: 215865 - DNA, 25 bp, E. coli
gacgaagaggaacaacaaaatggct

SEQ ID NO: 215866 - DNA, 25 bp, E. coli
gatgaaatacatgacgaagcaaaag

SEQ ID NO: 215867 - DNA, 25 bp, E. coli
gacgaagaggaagaacaaaatggct

SEQ ID NO: 215868 - DNA, 25 bp, E. coli
gatgaaatacatcacgaagcaaaag

SEQ ID NO: 215869 - DNA, 25 bp, E. coli
caaagcagtatcagaagcagatcac

SEQ ID NO: 215870 - DNA, 25 bp, E. coli
caaagcagtatctgaagcagatcac

SEQ ID NO: 215871 - DNA, 25 bp, E. coli
accggttgatacaggatgcctggag

SEQ ID NO: 215872 - DNA, 25 bp, E. coli
accggttgatactggatgcctggag

SEQ ID NO: 215873 - DNA, 25 bp, E. coli
tatcccggatctccaggaccgttct

SEQ ID NO: 215874 - DNA, 25 bp, E. coli
taccttcaacagcagaacgacctgg

SEQ ID NO: 215875 - DNA, 25 bp, E. coli
tatcccggatctgcaggaccgttct

SEQ ID NO: 215876 - DNA, 25 bp, E. coli
taccttcaacaggagaacgacctgg

SEQ ID NO: 215877 - DNA, 25 bp, E. coli
tatcagaacaaagtcgtcggcgtcc

SEQ ID NO: 215878 - DNA, 25 bp, E. coli
tatcagaacaaactcgtcggcgtcc

SEQ ID NO: 215879 - DNA, 25 bp, E. coli
tgtgaaccgaagacaacggagatca

SEQ ID NO: 215880 - DNA, 25 bp, E. coli
tgtgaaccgaagtcaacggagatca

SEQ ID NO: 215881 - DNA, 25 bp, E. coli
tctgccgtgtgaatatgacaatacc

SEQ ID NO: 215882 - DNA, 25 bp, E. coli
tctgccgtgtgattatgacaatacc

SEQ ID NO: 215883 - DNA, 25 bp, E. coli
cctcaaagagttcatatgggcgttc

SEQ ID NO: 215884 - DNA, 25 bp, E. coli
cctcaaagagttgatatgggcgttc

SEQ ID NO: 215885 - DNA, 25 bp, E. coli
tcgatggccctgaattggaccggtt

SEQ ID NO: 215886 - DNA, 25 bp, E. coli
tcgatggccctgtattggaccggtt

SEQ ID NO: 215887 - DNA, 25 bp, E. coli
ggactgtgaaaacatcctcaaagag

SEQ ID NO: 215888 - DNA, 25 bp, E. coli
ggactgtgaaaagatcctcaaagag

SEQ ID NO: 215889 - DNA, 25 bp, E. coli
gagtaacgtactcggcttcgcgtca

SEQ ID NO: 215890 - DNA, 25 bp, E. coli
gagtaacgtactgggcttcgcgtca

SEQ ID NO: 215891 - DNA, 25 bp, E. coli
cacaggcagtggttacgacgattac

SEQ ID NO: 215892 - DNA, 25 bp, E. coli
cacaggcagtggatacgacgattac

SEQ ID NO: 215893 - DNA, 25 bp, E. coli
tactgttacaggcagggtattgcca

SEQ ID NO: 215894 - DNA, 25 bp, E. coli
tactgttacagggagggtattgcca

SEQ ID NO: 215895 - DNA, 25 bp, E. coli
taccattggtaaaggaggaaaccca

SEQ ID NO: 215896 - DNA, 25 bp, E. coli
taccattggtaatggaggaaaccca

SEQ ID NO: 215897 - DNA, 25 bp, E. coli
ttacagtgagcattgggcaggcgac

SEQ ID NO: 215898 - DNA, 25 bp, E. coli
ttacagtgagcaatgggcaggcgac

SEQ ID NO: 215899 - DNA, 25 bp, E. coli
tgtattgcatttacagcacaggcag

SEQ ID NO: 215900 - DNA, 25 bp, E. coli
tgtattgcattttcagcacaggcag

SEQ ID NO: 215901 - DNA, 25 bp, E. coli
tccgtgccgtaagcaaaggtaatgc

SEQ ID NO: 215902 - DNA, 25 bp, E. coli
tccgtgccgtaaccaaaggtaatgc

SEQ ID NO: 215903 - DNA, 25 bp, E. coli
tcatggttgagcaacaggaacaagg

SEQ ID NO: 215904 - DNA, 25 bp, E. coli
tctgacctgataccagccaacagca

SEQ ID NO: 215905 - DNA, 25 bp, E. coli
tcatggttgagctacaggaacaagg

SEQ ID NO: 215906 - DNA, 25 bp, E. coli
tctgacctgatagcagccaacagca

SEQ ID NO: 215907 - DNA, 25 bp, E. coli
gccacctttggtcgaaccgcagaaa

SEQ ID NO: 215908 - DNA, 25 bp, E. coli
gccacctttggtggaaccgcagaaa

SEQ ID NO: 215909 - DNA, 25 bp, E. coli
gaaagctattattttggccaccggt

SEQ ID NO: 215910 - DNA, 25 bp, E. coli
gaaagctattatattggccaccggt

SEQ ID NO: 215911 - DNA, 25 bp, E. coli
gataacgcttactcttctgacctga

SEQ ID NO: 215912 - DNA, 25 bp, E. coli
gataacgcttacacttctgacctga

SEQ ID NO: 215913 - DNA, 25 bp, E. coli
ttcgaccgggattatccgtgacggc

SEQ ID NO: 215914 - DNA, 25 bp, E. coli
ttcgaccgggataatccgtgacggc

SEQ ID NO: 215915 - DNA, 25 bp, E. coli
tgccatcgcttccaccgggataatc

SEQ ID NO: 215916 - DNA, 25 bp, E. coli
tcgaccgggatattccgtgacggca

SEQ ID NO: 215917 - DNA, 25 bp, E. coli
tcgaccgggataatccgtgacggca

SEQ ID NO: 215918 - DNA, 25 bp, E. coli
tgccatcgcttcgaccgggataatc

SEQ ID NO: 215919 - DNA, 25 bp, E. coli
ccatcgcttcgagcgggataatccg

SEQ ID NO: 215920 - DNA, 25 bp, E. coli
ccgggataatccctgacggcagctt

SEQ ID NO: 215921 - DNA, 25 bp, E. coli
ccgggataatccgtgacggcagctt

SEQ ID NO: 215922 - DNA, 25 bp, E. coli
ccatcgcttcgaccgggataatccg

SEQ ID NO: 215923 - DNA, 25 bp, E. coli
gcttcgaccgggataatccgtgacg

SEQ ID NO: 215924 - DNA, 25 bp, E. coli
gcttcgaccgggttaatccgtgacg

SEQ ID NO: 215925 - DNA, 25 bp, E. coli
cgaccgggataaaccgtgacggcag

SEQ ID NO: 215926 - DNA, 25 bp, E. coli
cgaccgggataatccgtgacggcag

SEQ ID NO: 215927 - DNA, 25 bp, E. coli
gttgccatcgctacgaccgggataa

SEQ ID NO: 215928 - DNA, 25 bp, E. coli
gataatccgtgagggcagcttgctg

SEQ ID NO: 215929 - DNA, 25 bp, E. coli
gataatccgtgacggcagcttgctg

SEQ ID NO: 215930 - DNA, 25 bp, E. coli
gttgccatcgcttcgaccgggataa

SEQ ID NO: 215931 - DNA, 25 bp, E. coli
gggataatccgtgacggcagcttgc

SEQ ID NO: 215932 - DNA, 25 bp, E. coli
ggttgccatcgcttcgaccgggata

SEQ ID NO: 215933 - DNA, 25 bp, E. coli
ggttgccatcgcatcgaccgggata

SEQ ID NO: 215934 - DNA, 25 bp, E. coli
gggataatccgtcacggcagcttgc

SEQ ID NO: 215935 - DNA, 25 bp, E. coli
caccaggtcctggagaaaccgcttt

SEQ ID NO: 215936 - DNA, 25 bp, E. coli
caccaggtcctgcagaaaccgcttt

SEQ ID NO: 215937 - DNA, 25 bp, E. coli
agcaaggcggatagacggatcatcc

SEQ ID NO: 215938 - DNA, 25 bp, E. coli
agcaaggcggattgacggatcatcc

SEQ ID NO: 215939 - DNA, 25 bp, E. coli
ttaacactgaatctttacggctggg

SEQ ID NO: 215940 - DNA, 25 bp, E. coli
ttaacactgaatgtttacggctggg

SEQ ID NO: 215941 - DNA, 25 bp, E. coli
tttatctaacgagtaagcaaggcgg

SEQ ID NO: 215942 - DNA, 25 bp, E. coli
tttatctaacgactaagcaaggcgg

SEQ ID NO: 215943 - DNA, 25 bp, E. coli
tggtgaccaacatacgagcggctct

SEQ ID NO: 215944 - DNA, 25 bp, E. coli
tggtgaccaacaaacgagcggctct

SEQ ID NO: 215945 - DNA, 25 bp, E. coli
tgccaatcagttaacaccaggtcct

SEQ ID NO: 215946 - DNA, 25 bp, E. coli
tgccaatcagtttacaccaggtcct

SEQ ID NO: 215947 - DNA, 25 bp, E. coli
tcatccgggtcgctataaggtaagg

SEQ ID NO: 215948 - DNA, 25 bp, E. coli
tcatccgggtcggtataaggtaagg

SEQ ID NO: 215949 - DNA, 25 bp, E. coli
gctggccagtcatcgacaactttat

SEQ ID NO: 215950 - DNA, 25 bp, E. coli
gctggccagtcaacgacaactttat

SEQ ID NO: 215951 - DNA, 25 bp, E. coli
gcacaagaaacgctagctggccagt

SEQ ID NO: 215952 - DNA, 25 bp, E. coli
gcacaagaaacggtagctggccagt

SEQ ID NO: 215953 - DNA, 25 bp, E. coli
gaaaccgcttttgtggtgaccaaca

SEQ ID NO: 215954 - DNA, 25 bp, E. coli
gaaaccgcttttctggtgaccaaca

SEQ ID NO: 215955 - DNA, 25 bp, E. coli
cgcgggtgacgtaacggcacaagaa

SEQ ID NO: 215956 - DNA, 25 bp, E. coli
cgcgggtgacgttacggcacaagaa

SEQ ID NO: 215957 - DNA, 25 bp, E. coli
catgccgaaaccgaatgtaagaacg

SEQ ID NO: 215958 - DNA, 25 bp, E. coli
catgccgaaacccaatgtaagaacg

SEQ ID NO: 215959 - DNA, 25 bp, E. coli
tacaatgaaaaccatccgcacagtg

SEQ ID NO: 215960 - DNA, 25 bp, E. coli
tacaatgaaaacgatccgcacagtg

SEQ ID NO: 215961 - DNA, 25 bp, E. coli
atatcgacgtcaccgggtaacgtta

SEQ ID NO: 215962 - DNA, 25 bp, E. coli
atatcgacgtcagcgggtaacgtta

SEQ ID NO: 215963 - DNA, 25 bp, E. coli
aaaaccatccgcacagtgcgttggg

SEQ ID NO: 215964 - DNA, 25 bp, E. coli
aaaaccatccgctcagtgcgttggg

SEQ ID NO: 215965 - DNA, 25 bp, E. coli
gccgaaaccgaatgtaagaacggca

SEQ ID NO: 215966 - DNA, 25 bp, E. coli
gccgaaaccgaaagtaagaacggca

SEQ ID NO: 215967 - DNA, 25 bp, E. coli
gctctccgcgagaatatcgacgtca

SEQ ID NO: 215968 - DNA, 25 bp, E. coli
gctctccgcgagtatatcgacgtca

SEQ ID NO: 215969 - DNA, 25 bp, E. coli
gaaggaagactagatcgcgttcatg

SEQ ID NO: 215970 - DNA, 25 bp, E. coli
gaaggaagactacatcgcgttcatg

SEQ ID NO: 215971 - DNA, 25 bp, E. coli
cgagaatatcgaggtcagcgggtaa

SEQ ID NO: 215972 - DNA, 25 bp, E. coli
cgcgttcatgcccaaaccgaatgta

SEQ ID NO: 215973 - DNA, 25 bp, E. coli
cgagaatatcgacgtcagcgggtaa

SEQ ID NO: 215974 - DNA, 25 bp, E. coli
cgcgttcatgccgaaaccgaatgta

SEQ ID NO: 215975 - DNA, 25 bp, E. coli
gtgaaaacgatgaaggaagactaca

SEQ ID NO: 215976 - DNA, 25 bp, E. coli
gttgggttatcgctctccgcgagaa

SEQ ID NO: 215977 - DNA, 25 bp, E. coli
gttgggttatcggtctccgcgagaa

SEQ ID NO: 215978 - DNA, 25 bp, E. coli
gtgaaaacgatgtaggaagactaca

SEQ ID NO: 215979 - DNA, 25 bp, E. coli
caataagtatattgacgattgcact

SEQ ID NO: 215980 - DNA, 25 bp, E. coli
caataagtatatagacgattgcact

SEQ ID NO: 215981 - DNA, 25 bp, E. coli
ctagtgcctacgcagatttatcaga

SEQ ID NO: 215982 - DNA, 25 bp, E. coli
ctagtgcctacggagatttatcaga

SEQ ID NO: 215983 - DNA, 25 bp, E. coli
tttgatgtagaaactaagaatgacc

SEQ ID NO: 215984 - DNA, 25 bp, E. coli
tttgatgtagaatctaagaatgacc

SEQ ID NO: 215985 - DNA, 25 bp, E. coli
tgcaatgcccattgaacaatgtact

SEQ ID NO: 215986 - DNA, 25 bp, E. coli
tgcaccacaatttattagcttcgcg

SEQ ID NO: 215987 - DNA, 25 bp, E. coli
tgcaatgcccatagaacaatgtact

SEQ ID NO: 215988 - DNA, 25 bp, E. coli
tgcaccacaattaattagcttcgcg

SEQ ID NO: 215989 - DNA, 25 bp, E. coli
tagcttcgcgaactcgtttgaccca

SEQ ID NO: 215990 - DNA, 25 bp, E. coli
tagcttcgcgaagtcgtttgaccca

SEQ ID NO: 215991 - DNA, 25 bp, E. coli
cgattgcactgatgaggatttaaac

SEQ ID NO: 215992 - DNA, 25 bp, E. coli
cgattgcactgaagaggatttaaac

SEQ ID NO: 215993 - DNA, 25 bp, E. coli
gattaaaatactaacagacacttct

SEQ ID NO: 215994 - DNA, 25 bp, E. coli
gattaaaatacttacagacacttct

SEQ ID NO: 215995 - DNA, 25 bp, E. coli
ggataataaagatgcaatgcccatt

SEQ ID NO: 215996 - DNA, 25 bp, E. coli
ggataataaagaagcaatgcccatt

SEQ ID NO: 215997 - DNA, 25 bp, E. coli
taagaatgacctaccctccacggtt

SEQ ID NO: 215998 - DNA, 25 bp, E. coli
taatgaaaataaagagagctacctg

SEQ ID NO: 215999 - DNA, 25 bp, E. coli
taagaatgaccttccctccacggtt

SEQ ID NO: 216000 - DNA, 25 bp, E. coli
taatgaaaataatgagagctacctg

SEQ ID NO: 216001 - DNA, 25 bp, E. coli
taaatcaggcaataatgggccacgc

SEQ ID NO: 216002 - DNA, 25 bp, E. coli
taaaacggcactcgataacctggac

SEQ ID NO: 216003 - DNA, 25 bp, E. coli
taaacaagtcctggatattggcgcg

SEQ ID NO: 216004 - DNA, 25 bp, E. coli
taaaacggcactggataacctggac

SEQ ID NO: 216005 - DNA, 25 bp, E. coli
taaatcaggcaaaaatgggccacgc

SEQ ID NO: 216006 - DNA, 25 bp, E. coli
taaacaagtcctcgatattggcgcg

SEQ ID NO: 216007 - DNA, 25 bp, E. coli
tattggcgcgcatactctactgatc

SEQ ID NO: 216008 - DNA, 25 bp, E. coli
tattggcgcgcaaactctactgatc

SEQ ID NO: 216009 - DNA, 25 bp, E. coli
tgatccgtccggaggaaggcagtaa

SEQ ID NO: 216010 - DNA, 25 bp, E. coli
tgatccgtccggtggaaggcagtaa

SEQ ID NO: 216011 - DNA, 25 bp, E. coli
tgatatggcgcaccaatgcctggcg

SEQ ID NO: 216012 - DNA, 25 bp, E. coli
tgatatggcgcagcaatgcctggcg

SEQ ID NO: 216013 - DNA, 25 bp, E. coli
tctttctgcgtccttgggctacccg

SEQ ID NO: 216014 - DNA, 25 bp, E. coli
tctttctgcgtcgttgggctacccg

SEQ ID NO: 216015 - DNA, 25 bp, E. coli
gcgttgacacgaagctctacagcga

SEQ ID NO: 216016 - DNA, 25 bp, E. coli
gcgttgacacgatgctctacagcga

SEQ ID NO: 216017 - DNA, 25 bp, E. coli
gcaaattggtctctggttaagctca

SEQ ID NO: 216018 - DNA, 25 bp, E. coli
gcaaattggtctgtggttaagctca

SEQ ID NO: 216019 - DNA, 25 bp, E. coli
taagctcaacgactgcctatatggc

SEQ ID NO: 216020 - DNA, 25 bp, E. coli
taagctcaacgagtgcctatatggc

SEQ ID NO: 216021 - DNA, 25 bp, E. coli
gatgccctggatcaacgactggcga

SEQ ID NO: 216022 - DNA, 25 bp, E. coli
gatgccctggatgaacgactggcga

SEQ ID NO: 216023 - DNA, 25 bp, E. coli
cagattggcttgagttgcatgagca

SEQ ID NO: 216024 - DNA, 25 bp, E. coli
cagagaaataagcttttaacaggca

SEQ ID NO: 216025 - DNA, 25 bp, E. coli
cagagaaataaggttttaacaggca

SEQ ID NO: 216026 - DNA, 25 bp, E. coli
cagattggcttgtgttgcatgagca

SEQ ID NO: 216027 - DNA, 25 bp, E. coli
attggcttgtgtagcatgagcaacg

SEQ ID NO: 216028 - DNA, 25 bp, E. coli
attggcttgtgttgcatgagcaacg

SEQ ID NO: 216029 - DNA, 25 bp, E. coli
ttccagcagattggcttgtgttgca

SEQ ID NO: 216030 - DNA, 25 bp, E. coli
ttccagcagattcgcttgtgttgca

SEQ ID NO: 216031 - DNA, 25 bp, E. coli
gccagagaaatatgcttttaacagg

SEQ ID NO: 216032 - DNA, 25 bp, E. coli
ccagcagattggcttgtgttgcatg

SEQ ID NO: 216033 - DNA, 25 bp, E. coli
gccagagaaataagcttttaacagg

SEQ ID NO: 216034 - DNA, 25 bp, E. coli
ccagcagattgggttgtgttgcatg

SEQ ID NO: 216035 - DNA, 25 bp, E. coli
gaaataagctttaaacaggcaataa

SEQ ID NO: 216036 - DNA, 25 bp, E. coli
gaaataagcttttaacaggcaataa

SEQ ID NO: 216037 - DNA, 25 bp, E. coli
ctttccagcagattggcttgtgttg

SEQ ID NO: 216038 - DNA, 25 bp, E. coli
ctttccagcagaatggcttgtgttg

SEQ ID NO: 216039 - DNA, 25 bp, E. coli
gattggcttgtgatgcatgagcaac

SEQ ID NO: 216040 - DNA, 25 bp, E. coli
gattggcttgtgttgcatgagcaac

SEQ ID NO: 216041 - DNA, 25 bp, E. coli
gagccagagaaataagcttttaaca

SEQ ID NO: 216042 - DNA, 25 bp, E. coli
gagaaataagctattaacaggcaat

SEQ ID NO: 216043 - DNA, 25 bp, E. coli
gagaaataagcttttaacaggcaat

SEQ ID NO: 216044 - DNA, 25 bp, E. coli
gagccagagaaaaaagcttttaaca

SEQ ID NO: 216045 - DNA, 25 bp, E. coli
cattttttaagcagcaatgcggcgt

SEQ ID NO: 216046 - DNA, 25 bp, E. coli
cattttttaagctgcaatgcggcgt

SEQ ID NO: 216047 - DNA, 25 bp, E. coli
aaaaccacaccatttgaaacgctgt

SEQ ID NO: 216048 - DNA, 25 bp, E. coli
aaaaccacaccaattgaaacgctgt

SEQ ID NO: 216049 - DNA, 25 bp, E. coli
ttttttaagctgcaatgcggcgtaa

SEQ ID NO: 216050 - DNA, 25 bp, E. coli
ttttttaagctggaatgcggcgtaa

SEQ ID NO: 216051 - DNA, 25 bp, E. coli
tcggatcattgtatttattttgaaa

SEQ ID NO: 216052 - DNA, 25 bp, E. coli
tcggatcattgtttttattttgaaa

SEQ ID NO: 216053 - DNA, 25 bp, E. coli
tcattttttaaggtgcaatgcggcg

SEQ ID NO: 216054 - DNA, 25 bp, E. coli
tcattttttaagctgcaatgcggcg

SEQ ID NO: 216055 - DNA, 25 bp, E. coli
ccacaccaattgtaacgctgtttta

SEQ ID NO: 216056 - DNA, 25 bp, E. coli
ccacaccaattgaaacgctgtttta

SEQ ID NO: 216057 - DNA, 25 bp, E. coli
gaaattgatcactaaaaaaccaccg

SEQ ID NO: 216058 - DNA, 25 bp, E. coli
gaaattgatcacaaaaaaaccaccg

SEQ ID NO: 216059 - DNA, 25 bp, E. coli
cgctgttttattattatcggatcat

SEQ ID NO: 216060 - DNA, 25 bp, E. coli
cgctgttttatttttatcggatcat

SEQ ID NO: 216061 - DNA, 25 bp, E. coli
gatcacaaaaaatccaccgccgttg

SEQ ID NO: 216062 - DNA, 25 bp, E. coli
gatcaaaaccactccaattgaaacg

SEQ ID NO: 216063 - DNA, 25 bp, E. coli
gatcacaaaaaaaccaccgccgttg

SEQ ID NO: 216064 - DNA, 25 bp, E. coli
gtgatcaaaaccacaccaattgaaa

SEQ ID NO: 216065 - DNA, 25 bp, E. coli
gtgatcaaaacctcaccaattgaaa

SEQ ID NO: 216066 - DNA, 25 bp, E. coli
gatcaaaaccacaccaattgaaacg

SEQ ID NO: 216067 - DNA, 25 bp, E. coli
cagtatcggcagaaatgacctgacg

SEQ ID NO: 216068 - DNA, 25 bp, E. coli
cagtatcggcagtaatgacctgacg

SEQ ID NO: 216069 - DNA, 25 bp, E. coli
cgccattccccagagtaaatcggaa

SEQ ID NO: 216070 - DNA, 25 bp, E. coli
agcaagcgcgtaccgcagacggtat

SEQ ID NO: 216071 - DNA, 25 bp, E. coli
cgccattccccacagtaaatcggaa

SEQ ID NO: 216072 - DNA, 25 bp, E. coli
agcaagcgcgtagcgcagacggtat

SEQ ID NO: 216073 - DNA, 25 bp, E. coli
aatccgtggccccttattatcagca

SEQ ID NO: 216074 - DNA, 25 bp, E. coli
aatccgtggcccgttattatcagca

SEQ ID NO: 216075 - DNA, 25 bp, E. coli
tatccgtgctcgcaccgtgtgcagt

SEQ ID NO: 216076 - DNA, 25 bp, E. coli
ttcgccattcccgacagtaaatcgg

SEQ ID NO: 216077 - DNA, 25 bp, E. coli
ttcgccattccccacagtaaatcgg

SEQ ID NO: 216078 - DNA, 25 bp, E. coli
tatccgtgctcggaccgtgtgcagt

SEQ ID NO: 216079 - DNA, 25 bp, E. coli
tgctcgcaccgtctgcagtggtagc

SEQ ID NO: 216080 - DNA, 25 bp, E. coli
tgctcgcaccgtgtgcagtggtagc

SEQ ID NO: 216081 - DNA, 25 bp, E. coli
tgcaccgggtgaaagcgagctgtac

SEQ ID NO: 216082 - DNA, 25 bp, E. coli
tgcaccgggtgatagcgagctgtac

SEQ ID NO: 216083 - DNA, 25 bp, E. coli
ccagtgcaccggctgaaagcgagct

SEQ ID NO: 216084 - DNA, 25 bp, E. coli
ccagtgcaccgggtgaaagcgagct

SEQ ID NO: 216085 - DNA, 25 bp, E. coli
cgacgcaccgctggcggaagtaaaa

SEQ ID NO: 216086 - DNA, 25 bp, E. coli
cgacgcaccgctcgcggaagtaaaa

SEQ ID NO: 216087 - DNA, 25 bp, E. coli
cttcagtatcggcagtaatgacctg

SEQ ID NO: 216088 - DNA, 25 bp, E. coli
cttcagtatcgggagtaatgacctg

SEQ ID NO: 216089 - DNA, 25 bp, E. coli
aaggtgccgatacgctgattactgc

SEQ ID NO: 216090 - DNA, 25 bp, E. coli
aaggtgccgataggctgattactgc

SEQ ID NO: 216091 - DNA, 25 bp, E. coli
cagatgctctgcctgaaggtgccga

SEQ ID NO: 216092 - DNA, 25 bp, E. coli
cagatgctctgcgtgaaggtgccga

SEQ ID NO: 216093 - DNA, 25 bp, E. coli
tgtgtataccggaaaagcgatggcg

SEQ ID NO: 216094 - DNA, 25 bp, E. coli
tgtgtataccggtaaagcgatggcg

SEQ ID NO: 216095 - DNA, 25 bp, E. coli
tgcgtggcgctgctggaaaatccta

SEQ ID NO: 216096 - DNA, 25 bp, E. coli
tccacggctggagtttatcggcgcg

SEQ ID NO: 216097 - DNA, 25 bp, E. coli
tccacggctggactttatcggcgcg

SEQ ID NO: 216098 - DNA, 25 bp, E. coli
tgcgtggcgctggtggaaaatccta

SEQ ID NO: 216099 - DNA, 25 bp, E. coli
gactattttgcacctggctacggcg

SEQ ID NO: 216100 - DNA, 25 bp, E. coli
gactattttgcagctggctacggcg

SEQ ID NO: 216101 - DNA, 25 bp, E. coli
gaaaatcctattggcacaaccgcag

SEQ ID NO: 216102 - DNA, 25 bp, E. coli
gaaaatcctattcgcacaaccgcag

SEQ ID NO: 216103 - DNA, 25 bp, E. coli
gttgccgatcaaatgccgaaagtgg

SEQ ID NO: 216104 - DNA, 25 bp, E. coli
gttgccgatcaattgccgaaagtgg

SEQ ID NO: 216105 - DNA, 25 bp, E. coli
gggcgatccagtctaaccatgtgcg

SEQ ID NO: 216106 - DNA, 25 bp, E. coli
gggcgatccagtgtaaccatgtgcg

SEQ ID NO: 216107 - DNA, 25 bp, E. coli
ggaacacctgatgcctgaaagcgaa

SEQ ID NO: 216108 - DNA, 25 bp, E. coli
ggaacacctgatccctgaaagcgaa

SEQ ID NO: 216109 - DNA, 25 bp, E. coli
gacgcgagtcgaagcacaaggcttt

SEQ ID NO: 216110 - DNA, 25 bp, E. coli
gacgcgagtcgatgcacaaggcttt

SEQ ID NO: 216111 - DNA, 25 bp, E. coli
cagcggtcatggtattcgtttcacg

SEQ ID NO: 216112 - DNA, 25 bp, E. coli
cagcggtcatggaattcgtttcacg

SEQ ID NO: 216113 - DNA, 25 bp, E. coli
catattttcgtgtggtcagcggtca

SEQ ID NO: 216114 - DNA, 25 bp, E. coli
catattttcgtgaggtcagcggtca

SEQ ID NO: 216115 - DNA, 25 bp, E. coli
tatctgtcacggatgttctggctgc

SEQ ID NO: 216116 - DNA, 25 bp, E. coli
tatctgtcacggttgttctggctgc

SEQ ID NO: 216117 - DNA, 25 bp, E. coli
tattcccgtatagcgaaagccggct

SEQ ID NO: 216118 - DNA, 25 bp, E. coli
tattacgtccaatggtcatgcttgc

SEQ ID NO: 216119 - DNA, 25 bp, E. coli
tattacgtccaaaggtcatgcttgc

SEQ ID NO: 216120 - DNA, 25 bp, E. coli
tattcccgtataccgaaagccggct

SEQ ID NO: 216121 - DNA, 25 bp, E. coli
tgttgccagttatcggaaccggtcg

SEQ ID NO: 216122 - DNA, 25 bp, E. coli
tgttgccagttaacggaaccggtcg

SEQ ID NO: 216123 - DNA, 25 bp, E. coli
tcagtggtgccatgagttattcccg

SEQ ID NO: 216124 - DNA, 25 bp, E. coli
tcagtggtgccaagagttattcccg

SEQ ID NO: 216125 - DNA, 25 bp, E. coli
gtttcacgttgagatactcgggcta

SEQ ID NO: 216126 - DNA, 25 bp, E. coli
gtttcacgttgacatactcgggcta

SEQ ID NO: 216127 - DNA, 25 bp, E. coli
gatcttatgggttatgcagactgcc

SEQ ID NO: 216128 - DNA, 25 bp, E. coli
taatacgacgattgcatacgggagt

SEQ ID NO: 216129 - DNA, 25 bp, E. coli
taatacgacgatagcatacgggagt

SEQ ID NO: 216130 - DNA, 25 bp, E. coli
gatcttatgggtaatgcagactgcc

SEQ ID NO: 216131 - DNA, 25 bp, E. coli
gatggctatatcgtacctgggtgga

SEQ ID NO: 216132 - DNA, 25 bp, E. coli
gatggctatatcctacctgggtgga

SEQ ID NO: 216133 - DNA, 25 bp, E. coli
caataccgatcatgttccgccggga

SEQ ID NO: 216134 - DNA, 25 bp, E. coli
caataccgatcaagttccgccggga

SEQ ID NO: 216135 - DNA, 25 bp, E. coli
tacgcatatcaaatacaaataccgc

SEQ ID NO: 216136 - DNA, 25 bp, E. coli
taccgctacccggaaaatcagggca

SEQ ID NO: 216137 - DNA, 25 bp, E. coli
accgatcatgttccgccgggattaa

SEQ ID NO: 216138 - DNA, 25 bp, E. coli
accgatcatgttgcgccgggattaa

SEQ ID NO: 216139 - DNA, 25 bp, E. coli
atcagggcaagtttgatggcaatac

SEQ ID NO: 216140 - DNA, 25 bp, E. coli
tacccggaaaatgagggcaagtttg

SEQ ID NO: 216141 - DNA, 25 bp, E. coli
atcagggcaagtatgatggcaatac

SEQ ID NO: 216142 - DNA, 25 bp, E. coli
tacccggaaaatcagggcaagtttg

SEQ ID NO: 216143 - DNA, 25 bp, E. coli
tacgcatatcaattacaaataccgc

SEQ ID NO: 216144 - DNA, 25 bp, E. coli
taccgctacccgcaaaatcagggca

SEQ ID NO: 216145 - DNA, 25 bp, E. coli
gaaaatcagggcaagtttgatggca

SEQ ID NO: 216146 - DNA, 25 bp, E. coli
gaaaatcagggctagtttgatggca

SEQ ID NO: 216147 - DNA, 25 bp, E. coli
cgattatgacaacgctaacctgtat

SEQ ID NO: 216148 - DNA, 25 bp, E. coli
cgattatgacaaggctaacctgtat

SEQ ID NO: 216149 - DNA, 25 bp, E. coli
cgctaacctgtaaaacgatcatgtg

SEQ ID NO: 216150 - DNA, 25 bp, E. coli
cgctaacctgtataacgatcatgtg

SEQ ID NO: 216151 - DNA, 25 bp, E. coli
tcaaatacaaataccgctacccgga

SEQ ID NO: 216152 - DNA, 25 bp, E. coli
tcaaatacaaattccgctacccgga

SEQ ID NO: 216153 - DNA, 25 bp, E. coli
gatggcaataccgatcatgttccgc

SEQ ID NO: 216154 - DNA, 25 bp, E. coli
gatggcaatacccatcatgttccgc

SEQ ID NO: 216155 - DNA, 25 bp, E. coli
taaaaatgcgcacggcaacatactg

SEQ ID NO: 216156 - DNA, 25 bp, E. coli
taaaaatgcgcagggcaacatactg

SEQ ID NO: 216157 - DNA, 25 bp, E. coli
tatcgcgttatttgccgagatgggc

SEQ ID NO: 216158 - DNA, 25 bp, E. coli
tatttaaacgatgacctggtacagg

SEQ ID NO: 216159 - DNA, 25 bp, E. coli
tatttaaacgatcacctggtacagg

SEQ ID NO: 216160 - DNA, 25 bp, E. coli
tattgtcgagaacggattaggcgca

SEQ ID NO: 216161 - DNA, 25 bp, E. coli
tatcgcgttattagccgagatgggc

SEQ ID NO: 216162 - DNA, 25 bp, E. coli
tatatgcagcgtttcttccgcgacc

SEQ ID NO: 216163 - DNA, 25 bp, E. coli
tattgtcgagaagggattaggcgca

SEQ ID NO: 216164 - DNA, 25 bp, E. coli
tatatgcagcgtatcttccgcgacc

SEQ ID NO: 216165 - DNA, 25 bp, E. coli
tgttgcaggccaaggaagagaaccg

SEQ ID NO: 216166 - DNA, 25 bp, E. coli
tgttgcaggccatggaagagaaccg

SEQ ID NO: 216167 - DNA, 25 bp, E. coli
cgtatttccattgcctgggcgcgaa

SEQ ID NO: 216168 - DNA, 25 bp, E. coli
cgtatttccattccctgggcgcgaa

SEQ ID NO: 216169 - DNA, 25 bp, E. coli
ggttgtgtttcccacgacgaaagca

SEQ ID NO: 216170 - DNA, 25 bp, E. coli
ggttgtgtttccgacgacgaaagca

SEQ ID NO: 216171 - DNA, 25 bp, E. coli
taatgggaaaaaaggaaccgcgcat

SEQ ID NO: 216172 - DNA, 25 bp, E. coli
taatgggaaaaatggaaccgcgcat

SEQ ID NO: 216173 - DNA, 25 bp, E. coli
tcacaaatgtctaagcgctacggct

SEQ ID NO: 216174 - DNA, 25 bp, E. coli
tcacaaatgtcttagcgctacggct

SEQ ID NO: 216175 - DNA, 25 bp, E. coli
gagatgggcttctcctgtctgcgta

SEQ ID NO: 216176 - DNA, 25 bp, E. coli
gagatgggcttcacctgtctgcgta

SEQ ID NO: 216177 - DNA, 25 bp, E. coli
caaatgtcaataccgcatatcgtga

SEQ ID NO: 216178 - DNA, 25 bp, E. coli
caaatgtcaatagcgcatatcgtga

SEQ ID NO: 216179 - DNA, 25 bp, E. coli
catatcaaggtattaaaaaaggtcg

SEQ ID NO: 216180 - DNA, 25 bp, E. coli
catatcaaggtaataaaaaaggtcg

SEQ ID NO: 216181 - DNA, 25 bp, E. coli
taaatatttgtgatctacaacacgc

SEQ ID NO: 216182 - DNA, 25 bp, E. coli
tactcgtgcggtttaatgaaagcaa

SEQ ID NO: 216183 - DNA, 25 bp, E. coli
tactcgtgcggtataatgaaagcaa

SEQ ID NO: 216184 - DNA, 25 bp, E. coli
taaatatttgtgttctacaacacgc

SEQ ID NO: 216185 - DNA, 25 bp, E. coli
tacaacacgcctaatctattgcttg

SEQ ID NO: 216186 - DNA, 25 bp, E. coli
tacaacacgccttatctattgcttg

SEQ ID NO: 216187 - DNA, 25 bp, E. coli
aaagcaattgaggagggaaaccggt

SEQ ID NO: 216188 - DNA, 25 bp, E. coli
aaagcaattgagcagggaaaccggt

SEQ ID NO: 216189 - DNA, 25 bp, E. coli
tatctattgcttgtccgcaaacgga

SEQ ID NO: 216190 - DNA, 25 bp, E. coli
tatctattgcttctccgcaaacgga

SEQ ID NO: 216191 - DNA, 25 bp, E. coli
tccgcaaacggagatatcaaggtaa

SEQ ID NO: 216192 - DNA, 25 bp, E. coli
tccgcaaacggacatatcaaggtaa

SEQ ID NO: 216193 - DNA, 25 bp, E. coli
gcggtaaaaatataatactcgtgcg

SEQ ID NO: 216194 - DNA, 25 bp, E. coli
gcggtaaaaataaaatactcgtgcg

SEQ ID NO: 216195 - DNA, 25 bp, E. coli
gaagcaccttttaacccgaaatgct

SEQ ID NO: 216196 - DNA, 25 bp, E. coli
gaagcacctttttacccgaaatgct

SEQ ID NO: 216197 - DNA, 25 bp, E. coli
cgcatatcgtgatgcatattacata

SEQ ID NO: 216198 - DNA, 25 bp, E. coli
cgcatatcgtgaagcatattacata

SEQ ID NO: 216199 - DNA, 25 bp, E. coli
aattctggcaatccttccgcgcgag

SEQ ID NO: 216200 - DNA, 25 bp, E. coli
aattctggcaatgcttccgcgcgag

SEQ ID NO: 216201 - DNA, 25 bp, E. coli
caggcatgggtagccaatgcaatta

SEQ ID NO: 216202 - DNA, 25 bp, E. coli
caggcatgggtacccaatgcaatta

SEQ ID NO: 216203 - DNA, 25 bp, E. coli
aaaagggcaggcatgggtagccaat

SEQ ID NO: 216204 - DNA, 25 bp, E. coli
aaaagggcaggcttgggtagccaat

SEQ ID NO: 216205 - DNA, 25 bp, E. coli
aaaattcagaaggtgatcccagcaa

SEQ ID NO: 216206 - DNA, 25 bp, E. coli
aaaattcagaagctgatcccagcaa

SEQ ID NO: 216207 - DNA, 25 bp, E. coli
gaaaacgcaaagagaaaaaattcag

SEQ ID NO: 216208 - DNA, 25 bp, E. coli
gaaaacgcaaagtgaaaaaattcag

SEQ ID NO: 216209 - DNA, 25 bp, E. coli
gcggttcttccgacgattctgtcat

SEQ ID NO: 216210 - DNA, 25 bp, E. coli
gcggttcttccgtcgattctgtcat

SEQ ID NO: 216211 - DNA, 25 bp, E. coli
gaagctgatcccagcaattctggca

SEQ ID NO: 216212 - DNA, 25 bp, E. coli
gaagctgatccctgcaattctggca

SEQ ID NO: 216213 - DNA, 25 bp, E. coli
cgcaggaagcgttaagtacggcaat

SEQ ID NO: 216214 - DNA, 25 bp, E. coli
cgcaggaagcgtaaagtacggcaat

SEQ ID NO: 216215 - DNA, 25 bp, E. coli
cgacgattctgtcattgttcattaa

SEQ ID NO: 216216 - DNA, 25 bp, E. coli
cgacgattctgtgattgttcattaa

SEQ ID NO: 216217 - DNA, 25 bp, E. coli
ggtagccaatgctattactgaagaa

SEQ ID NO: 216218 - DNA, 25 bp, E. coli
ggtagccaatgcaattactgaagaa

SEQ ID NO: 216219 - DNA, 25 bp, E. coli
ggaagcgttaagtacggcaattgat

SEQ ID NO: 216220 - DNA, 25 bp, E. coli
ggaagcgttaagaacggcaattgat

SEQ ID NO: 216221 - DNA, 25 bp, E. coli
aattttttacgcagcgccaactggg

SEQ ID NO: 216222 - DNA, 25 bp, E. coli
aattttttacgctgcgccaactggg

SEQ ID NO: 216223 - DNA, 25 bp, E. coli
agagaaatatctctacattattgag

SEQ ID NO: 216224 - DNA, 25 bp, E. coli
agagaaatatctgtacattattgag

SEQ ID NO: 216225 - DNA, 25 bp, E. coli
attcgcgcaattcgcgccaaagccg

SEQ ID NO: 216226 - DNA, 25 bp, E. coli
attcgcgcaattggcgccaaagccg

SEQ ID NO: 216227 - DNA, 25 bp, E. coli
tttacgctgcgcgaactgggaagag

SEQ ID NO: 216228 - DNA, 25 bp, E. coli
tttacgctgcgccaactgggaagag

SEQ ID NO: 216229 - DNA, 25 bp, E. coli
tgcgccaactggcaagagaaatatc

SEQ ID NO: 216230 - DNA, 25 bp, E. coli
tgcgccaactgggaagagaaatatc

SEQ ID NO: 216231 - DNA, 25 bp, E. coli
gccaactgggaagagaaatatctct

SEQ ID NO: 216232 - DNA, 25 bp, E. coli
gccaactgggaacagaaatatctct

SEQ ID NO: 216233 - DNA, 25 bp, E. coli
gctgcgtaattttttacgctgcgcc

SEQ ID NO: 216234 - DNA, 25 bp, E. coli
gctgcgtaatttattacgctgcgcc

SEQ ID NO: 216235 - DNA, 25 bp, E. coli
cgatgattcgcggaattcgcgccaa

SEQ ID NO: 216236 - DNA, 25 bp, E. coli
cgatgattcgcgcaattcgcgccaa

SEQ ID NO: 216237 - DNA, 25 bp, E. coli
ctggaagcgatgattcgcgcaattc

SEQ ID NO: 216238 - DNA, 25 bp, E. coli
ctggaagcgatgtttcgcgcaattc

SEQ ID NO: 216239 - DNA, 25 bp, E. coli
gggcttattgcgctcgtctttattc

SEQ ID NO: 216240 - DNA, 25 bp, E. coli
gggcttattgcggtcgtctttattc

SEQ ID NO: 216241 - DNA, 25 bp, E. coli
tggctttattgccggataaagaaaa

SEQ ID NO: 216242 - DNA, 25 bp, E. coli
tggctttattgcgggataaagaaaa

SEQ ID NO: 216243 - DNA, 25 bp, E. coli
catctgtgttcctcctctacccaac

SEQ ID NO: 216244 - DNA, 25 bp, E. coli
catctgtgttccacctctacccaac

SEQ ID NO: 216245 - DNA, 25 bp, E. coli
atttttgactatgaaacggaatgcg

SEQ ID NO: 216246 - DNA, 25 bp, E. coli
atttttgactatcaaacggaatgcg

SEQ ID NO: 216247 - DNA, 25 bp, E. coli
acggcattaccggtggagagaaaga

SEQ ID NO: 216248 - DNA, 25 bp, E. coli
acggcattaccgctggagagaaaga

SEQ ID NO: 216249 - DNA, 25 bp, E. coli
ttcgacggcattaccgctggagaga

SEQ ID NO: 216250 - DNA, 25 bp, E. coli
ttcttcgacggctttaccgctggag

SEQ ID NO: 216251 - DNA, 25 bp, E. coli
ttcgacggcatttccgctggagaga

SEQ ID NO: 216252 - DNA, 25 bp, E. coli
ttcttcgacggcattaccgctggag

SEQ ID NO: 216253 - DNA, 25 bp, E. coli
tcctctacccaagctgcatcagata

SEQ ID NO: 216254 - DNA, 25 bp, E. coli
tcgacggcattagcgctggagagaa

SEQ ID NO: 216255 - DNA, 25 bp, E. coli
tcgacggcattaccgctggagagaa

SEQ ID NO: 216256 - DNA, 25 bp, E. coli
tcttcgacggcaataccgctggaga

SEQ ID NO: 216257 - DNA, 25 bp, E. coli
tcttcgacggcattaccgctggaga

SEQ ID NO: 216258 - DNA, 25 bp, E. coli
gcattaccgctggagagaaagattt

SEQ ID NO: 216259 - DNA, 25 bp, E. coli
gcattaccgctgcagagaaagattt

SEQ ID NO: 216260 - DNA, 25 bp, E. coli
cggcattaccgctggagagaaagat

SEQ ID NO: 216261 - DNA, 25 bp, E. coli
cggcattaccgcaggagagaaagat

SEQ ID NO: 216262 - DNA, 25 bp, E. coli
gggatttttgacaatgaaacggaat

SEQ ID NO: 216263 - DNA, 25 bp, E. coli
gggatttttgactatgaaacggaat

SEQ ID NO: 216264 - DNA, 25 bp, E. coli
tcctctacccaacctgcatcagata

SEQ ID NO: 216265 - DNA, 25 bp, E. coli
aagtgaaccgcgagctgaaggcgca

SEQ ID NO: 216266 - DNA, 25 bp, E. coli
aagtgaaccgcgtgctgaaggcgca

SEQ ID NO: 216267 - DNA, 25 bp, E. coli
tattctgaagaagtgaaccgcgtgc

SEQ ID NO: 216268 - DNA, 25 bp, E. coli
tttgaggcacaattcgacgcatatg

SEQ ID NO: 216269 - DNA, 25 bp, E. coli
tttgaggcacaaatcgacgcatatg

SEQ ID NO: 216270 - DNA, 25 bp, E. coli
tattctgaagaactgaaccgcgtgc

SEQ ID NO: 216271 - DNA, 25 bp, E. coli
ttaaaggcacggttactgaagagct

SEQ ID NO: 216272 - DNA, 25 bp, E. coli
ttaaaggcacggatactgaagagct

SEQ ID NO: 216273 - DNA, 25 bp, E. coli
tgatgaagtgctggcccgaatggtt

SEQ ID NO: 216274 - DNA, 25 bp, E. coli
tgatgaagtgctcgcccgaatggtt

SEQ ID NO: 216275 - DNA, 25 bp, E. coli
tcagcccggaactgacggtactatg

SEQ ID NO: 216276 - DNA, 25 bp, E. coli
tcagcccggaacagacggtactatg

SEQ ID NO: 216277 - DNA, 25 bp, E. coli
gctgaaaacagcacggaaaatgatc

SEQ ID NO: 216278 - DNA, 25 bp, E. coli
gctgaaaacagctcggaaaatgatc

SEQ ID NO: 216279 - DNA, 25 bp, E. coli
gaatggttggcccttctccggctga

SEQ ID NO: 216280 - DNA, 25 bp, E. coli
gaatggttggccgttctccggctga

SEQ ID NO: 216281 - DNA, 25 bp, E. coli
gaaaatgatcctgaacccgtagagc

SEQ ID NO: 216282 - DNA, 25 bp, E. coli
gaaaatgatcctcaacccgtagagc

SEQ ID NO: 216283 - DNA, 25 bp, E. coli
cgcaggttcgcaaggattttgaggc

SEQ ID NO: 216284 - DNA, 25 bp, E. coli
cgcaggttcgcatggattttgaggc

SEQ ID NO: 216285 - DNA, 25 bp, E. coli
ctgaagagcttgtcaaacaggcact

SEQ ID NO: 216286 - DNA, 25 bp, E. coli
ctgaagagcttgacaaacaggcact

SEQ ID NO: 216287 - DNA, 25 bp, E. coli
cagttgctcgattaagtcacgccct

SEQ ID NO: 216288 - DNA, 25 bp, E. coli
cagttgctcgataaagtcacgccct

SEQ ID NO: 216289 - DNA, 25 bp, E. coli
taacaacgggtgacgcctatggtac

SEQ ID NO: 216290 - DNA, 25 bp, E. coli
tacagttgctcgataaagtcacgcc

SEQ ID NO: 216291 - DNA, 25 bp, E. coli
taaagtcacgccgtcacagtgggcg

SEQ ID NO: 216292 - DNA, 25 bp, E. coli
taaagtcacgccctcacagtgggcg

SEQ ID NO: 216293 - DNA, 25 bp, E. coli
tacagttgctcgttaaagtcacgcc

SEQ ID NO: 216294 - DNA, 25 bp, E. coli
acagttgctcgataaagtcacgccc

SEQ ID NO: 216295 - DNA, 25 bp, E. coli
acagttgctcgaaaaagtcacgccc

SEQ ID NO: 216296 - DNA, 25 bp, E. coli
tacctcagcaggtagtgccgggtac

SEQ ID NO: 216297 - DNA, 25 bp, E. coli
tacctcagcaggaagtgccgggtac

SEQ ID NO: 216298 - DNA, 25 bp, E. coli
ttgctcgataaactcacgccctcac

SEQ ID NO: 216299 - DNA, 25 bp, E. coli
ttgctcgataaagtcacgccctcac

SEQ ID NO: 216300 - DNA, 25 bp, E. coli
tttacagttgctcgataaagtcacg

SEQ ID NO: 216301 - DNA, 25 bp, E. coli
tttacagttgctggataaagtcacg

SEQ ID NO: 216302 - DNA, 25 bp, E. coli
tgtcgcctatggtacctcagcaggt

SEQ ID NO: 216303 - DNA, 25 bp, E. coli
tgtcgcctatggaacctcagcaggt

SEQ ID NO: 216304 - DNA, 25 bp, E. coli
tgccgggtactgctttttacagttg

SEQ ID NO: 216305 - DNA, 25 bp, E. coli
tgccgggtactggtttttacagttg

SEQ ID NO: 216306 - DNA, 25 bp, E. coli
gttgctcgataatgtcacgccctca

SEQ ID NO: 216307 - DNA, 25 bp, E. coli
gttgctcgataaagtcacgccctca

SEQ ID NO: 216308 - DNA, 25 bp, E. coli
taacaacgggtgtcgcctatggtac

SEQ ID NO: 216309 - DNA, 25 bp, E. coli
aatcctggatgtggcagagttctgc

SEQ ID NO: 216310 - DNA, 25 bp, E. coli
aatcctggatgtcgcagagttctgc

SEQ ID NO: 216311 - DNA, 25 bp, E. coli
caaaaatgggagagtttctgaaccg

SEQ ID NO: 216312 - DNA, 25 bp, E. coli
caaaaatgggagtgtttctgaaccg

SEQ ID NO: 216313 - DNA, 25 bp, E. coli
catcgagcgggtaccactatcatta

SEQ ID NO: 216314 - DNA, 25 bp, E. coli
catcgagcgggttccactatcatta

SEQ ID NO: 216315 - DNA, 25 bp, E. coli
tgagcttacagccatcaaaaatggg

SEQ ID NO: 216316 - DNA, 25 bp, E. coli
tgagcttacagcgatcaaaaatggg

SEQ ID NO: 216317 - DNA, 25 bp, E. coli
tctgcttttgtgagacgggcttttc

SEQ ID NO: 216318 - DNA, 25 bp, E. coli
tcttctgcgacatgtcatcgagcgg

SEQ ID NO: 216319 - DNA, 25 bp, E. coli
tcttctgcgacaagtcatcgagcgg

SEQ ID NO: 216320 - DNA, 25 bp, E. coli
tctgcttttgtgtgacgggcttttc

SEQ ID NO: 216321 - DNA, 25 bp, E. coli
gaagaaacccgctaacaaatcctgg

SEQ ID NO: 216322 - DNA, 25 bp, E. coli
gaagaaacccgcaaacaaatcctgg

SEQ ID NO: 216323 - DNA, 25 bp, E. coli
cggaaattcgtactgagactctggc

SEQ ID NO: 216324 - DNA, 25 bp, E. coli
cggaaattcgtagtgagactctggc

SEQ ID NO: 216325 - DNA, 25 bp, E. coli
ggtgcggcacacaaaatttgcagcg

SEQ ID NO: 216326 - DNA, 25 bp, E. coli
ggagatttcaacagtggtgcggcac

SEQ ID NO: 216327 - DNA, 25 bp, E. coli
ggtgcggcacactaaatttgcagcg

SEQ ID NO: 216328 - DNA, 25 bp, E. coli
ggcttttcaaagacgacactggaga

SEQ ID NO: 216329 - DNA, 25 bp, E. coli
ggcttttcaaagtcgacactggaga

SEQ ID NO: 216330 - DNA, 25 bp, E. coli
ggagatttcaactgtggtgcggcac

SEQ ID NO: 216331 - DNA, 25 bp, E. coli
caagatcagggctacgtcagtggca

SEQ ID NO: 216332 - DNA, 25 bp, E. coli
caagatcagggcaacgtcagtggca

SEQ ID NO: 216333 - DNA, 25 bp, E. coli
taaaacgactgggtcggcttcaggc

SEQ ID NO: 216334 - DNA, 25 bp, E. coli
tagtctggcgtctcaaatggtcgag

SEQ ID NO: 216335 - DNA, 25 bp, E. coli
tatgccttagttctggtgccgcaga

SEQ ID NO: 216336 - DNA, 25 bp, E. coli
tatgccttagttgtggtgccgcaga

SEQ ID NO: 216337 - DNA, 25 bp, E. coli
tagtctggcgtcacaaatggtcgag

SEQ ID NO: 216338 - DNA, 25 bp, E. coli
tatggctacctggacaaagtggcgc

SEQ ID NO: 216339 - DNA, 25 bp, E. coli
tatggctacctgcacaaagtggcgc

SEQ ID NO: 216340 - DNA, 25 bp, E. coli
tataggtaccaatgaccagccgtgg

SEQ ID NO: 216341 - DNA, 25 bp, E. coli
tataggtaccaaagaccagccgtgg

SEQ ID NO: 216342 - DNA, 25 bp, E. coli
tttccagcggaacaacgatagcagg

SEQ ID NO: 216343 - DNA, 25 bp, E. coli
tttccagcggaagaacgatagcagg

SEQ ID NO: 216344 - DNA, 25 bp, E. coli
ttgaaagcggcaaataaacccagcg

SEQ ID NO: 216345 - DNA, 25 bp, E. coli
ttgaaagcggcatataaacccagcg

SEQ ID NO: 216346 - DNA, 25 bp, E. coli
tcgatgaaccgagctgtgcaacagt

SEQ ID NO: 216347 - DNA, 25 bp, E. coli
tcgatgaaccgacctgtgcaacagt

SEQ ID NO: 216348 - DNA, 25 bp, E. coli
tcagtggcaatcaggtaacgcttgg

SEQ ID NO: 216349 - DNA, 25 bp, E. coli
tcagtggcaatctggtaacgcttgg

SEQ ID NO: 216350 - DNA, 25 bp, E. coli
tggaacattttctggtaacgcgacc

SEQ ID NO: 216351 - DNA, 25 bp, E. coli
tggaacattttcaggtaacgcgacc

SEQ ID NO: 216352 - DNA, 25 bp, E. coli
taaaacgactggctcggcttcaggc

SEQ ID NO: 216353 - DNA, 25 bp, E. coli
caagtgttgattaaaaatccgccga

SEQ ID NO: 216354 - DNA, 25 bp, E. coli
caagtgttgatttaaaatccgccga

SEQ ID NO: 216355 - DNA, 25 bp, E. coli
cacaagtgttgattaaaaatccgcc

SEQ ID NO: 216356 - DNA, 25 bp, E. coli
cacaagtgttgaataaaaatccgcc

SEQ ID NO: 216357 - DNA, 25 bp, E. coli
attgcggaagatcgcgatccacaag

SEQ ID NO: 216358 - DNA, 25 bp, E. coli
agtgttgattaaaaatccgccgagc

SEQ ID NO: 216359 - DNA, 25 bp, E. coli
agtgttgattaataatccgccgagc

SEQ ID NO: 216360 - DNA, 25 bp, E. coli
attgcggaagatggcgatccacaag

SEQ ID NO: 216361 - DNA, 25 bp, E. coli
ttgattaaaaatccgccgagccagc

SEQ ID NO: 216362 - DNA, 25 bp, E. coli
ttgattaaaaatgcgccgagccagc

SEQ ID NO: 216363 - DNA, 25 bp, E. coli
tgttgattaaaattccgccgagcca

SEQ ID NO: 216364 - DNA, 25 bp, E. coli
tgttgattaaaaatccgccgagcca

SEQ ID NO: 216365 - DNA, 25 bp, E. coli
tccacaagtgttgattaaaaatccg

SEQ ID NO: 216366 - DNA, 25 bp, E. coli
tccacaagtgttcattaaaaatccg

SEQ ID NO: 216367 - DNA, 25 bp, E. coli
gcggaagatggccatccacaagtgt

SEQ ID NO: 216368 - DNA, 25 bp, E. coli
gcggaagatggcgatccacaagtgt

SEQ ID NO: 216369 - DNA, 25 bp, E. coli
ggaagatggcgatccacaagtgttg

SEQ ID NO: 216370 - DNA, 25 bp, E. coli
ggcgatccacaactgttgattaaaa

SEQ ID NO: 216371 - DNA, 25 bp, E. coli
ggaagatggcgaaccacaagtgttg

SEQ ID NO: 216372 - DNA, 25 bp, E. coli
ggcgatccacaagtgttgattaaaa

SEQ ID NO: 216373 - DNA, 25 bp, E. coli
gatggcgatccacaagtgttgatta

SEQ ID NO: 216374 - DNA, 25 bp, E. coli
gatggcgatccagaagtgttgatta

SEQ ID NO: 216375 - DNA, 25 bp, E. coli
atctggcattctaacgctatatggg

SEQ ID NO: 216376 - DNA, 25 bp, E. coli
aggtcgcgcttgaggctatctggca

SEQ ID NO: 216377 - DNA, 25 bp, E. coli
atctggcattcttacgctatatggg

SEQ ID NO: 216378 - DNA, 25 bp, E. coli
aggtcgcgcttgtggctatctggca

SEQ ID NO: 216379 - DNA, 25 bp, E. coli
ttgaggctatctcgcattcttacgc

SEQ ID NO: 216380 - DNA, 25 bp, E. coli
ttcttacgctatatggggctatgtc

SEQ ID NO: 216381 - DNA, 25 bp, E. coli
ttcttacgctatttggggctatgtc

SEQ ID NO: 216382 - DNA, 25 bp, E. coli
ttgaggctatctggcattcttacgc

SEQ ID NO: 216383 - DNA, 25 bp, E. coli
tcgcgcttgaggctatctggcattc

SEQ ID NO: 216384 - DNA, 25 bp, E. coli
tcgcgcttgagggtatctggcattc

SEQ ID NO: 216385 - DNA, 25 bp, E. coli
cgcttgaggctatctggcattctta

SEQ ID NO: 216386 - DNA, 25 bp, E. coli
cgcttgaggctaactggcattctta

SEQ ID NO: 216387 - DNA, 25 bp, E. coli
cgtccgtttttccatgctcttatgg

SEQ ID NO: 216388 - DNA, 25 bp, E. coli
cgtccgtttttcgatgctcttatgg

SEQ ID NO: 216389 - DNA, 25 bp, E. coli
gggctatgtctcaaaccttcgtcat

SEQ ID NO: 216390 - DNA, 25 bp, E. coli
gggctatgtctctaaccttcgtcat

SEQ ID NO: 216391 - DNA, 25 bp, E. coli
ggctatctggcattcttacgctata

SEQ ID NO: 216392 - DNA, 25 bp, E. coli
ggctatctggcaatcttacgctata

SEQ ID NO: 216393 - DNA, 25 bp, E. coli
gagcgtccgtttttcgatgctctta

SEQ ID NO: 216394 - DNA, 25 bp, E. coli
gaggctatctggcattcttacgcta

SEQ ID NO: 216395 - DNA, 25 bp, E. coli
gagcgtccgtttatcgatgctctta

SEQ ID NO: 216396 - DNA, 25 bp, E. coli
gaggctatctgggattcttacgcta

SEQ ID NO: 216397 - DNA, 25 bp, E. coli
caatgttttatggtgcccgcagtgg

SEQ ID NO: 216398 - DNA, 25 bp, E. coli
caatgttttatgctgcccgcagtgg

SEQ ID NO: 216399 - DNA, 25 bp, E. coli
cagactgtcatagaaggcggcaacc

SEQ ID NO: 216400 - DNA, 25 bp, E. coli
cagactgtcatacaaggcggcaacc

SEQ ID NO: 216401 - DNA, 25 bp, E. coli
catgcagattgacccgctggaagcg

SEQ ID NO: 216402 - DNA, 25 bp, E. coli
catgcagattgagccgctggaagcg

SEQ ID NO: 216403 - DNA, 25 bp, E. coli
tatttacacggtatcaacagctcgc

SEQ ID NO: 216404 - DNA, 25 bp, E. coli
tatttacacggtttcaacagctcgc

SEQ ID NO: 216405 - DNA, 25 bp, E. coli
ttgaactgctgagggactatctcgg

SEQ ID NO: 216406 - DNA, 25 bp, E. coli
ttgaactgctgacggactatctcgg

SEQ ID NO: 216407 - DNA, 25 bp, E. coli
tgagatgatcattccgcagttgccg

SEQ ID NO: 216408 - DNA, 25 bp, E. coli
tgagatgatcataccgcagttgccg

SEQ ID NO: 216409 - DNA, 25 bp, E. coli
gcttgttaaaaatctggctggcgga

SEQ ID NO: 216410 - DNA, 25 bp, E. coli
gcttgttaaaaaactggctggcgga

SEQ ID NO: 216411 - DNA, 25 bp, E. coli
gaagattatttcaacccgatcgtcg

SEQ ID NO: 216412 - DNA, 25 bp, E. coli
gaagattatttctacccgatcgtcg

SEQ ID NO: 216413 - DNA, 25 bp, E. coli
gatctggctgctccaacagacggga

SEQ ID NO: 216414 - DNA, 25 bp, E. coli
ggcggaacatcaccctgacgttgag

SEQ ID NO: 216415 - DNA, 25 bp, E. coli
ggcggaacatcagcctgacgttgag

SEQ ID NO: 216416 - DNA, 25 bp, E. coli
gagatgaagtgctggattaccgcca

SEQ ID NO: 216417 - DNA, 25 bp, E. coli
gatctggctgctgcaacagacggga

SEQ ID NO: 216418 - DNA, 25 bp, E. coli
gagatgaagtgcaggattaccgcca

SEQ ID NO: 216419 - DNA, 25 bp, E. coli
caacgatctggtgtcagtcaggcga

SEQ ID NO: 216420 - DNA, 25 bp, E. coli
cacttgtacttttggctgaccagca

SEQ ID NO: 216421 - DNA, 25 bp, E. coli
cacttgtactttaggctgaccagca

SEQ ID NO: 216422 - DNA, 25 bp, E. coli
caacgatctggtctcagtcaggcga

SEQ ID NO: 216423 - DNA, 25 bp, E. coli
tagtcgatagcgttattgcacgttt

SEQ ID NO: 216424 - DNA, 25 bp, E. coli
tagtcgatagcgatattgcacgttt

SEQ ID NO: 216425 - DNA, 25 bp, E. coli
tgttactcaagctcagaaagtctcg

SEQ ID NO: 216426 - DNA, 25 bp, E. coli
tgttactcaagcacagaaagtctcg

SEQ ID NO: 216427 - DNA, 25 bp, E. coli
tgaagaaacaggcattacccgctgg

SEQ ID NO: 216428 - DNA, 25 bp, E. coli
tgaagaaacagggattacccgctgg

SEQ ID NO: 216429 - DNA, 25 bp, E. coli
tcagtcaggcgaagatcagcaaagt

SEQ ID NO: 216430 - DNA, 25 bp, E. coli
tcagtcaggcgatgatcagcaaagt

SEQ ID NO: 216431 - DNA, 25 bp, E. coli
gccccagtgcaagaatacttagtcg

SEQ ID NO: 216432 - DNA, 25 bp, E. coli
gccccagtgcaacaatacttagtcg

SEQ ID NO: 216433 - DNA, 25 bp, E. coli
gactgttacagaccttgcccaacga

SEQ ID NO: 216434 - DNA, 25 bp, E. coli
gactgttacagagcttgcccaacga

SEQ ID NO: 216435 - DNA, 25 bp, E. coli
ggctgaccagcatcaacattggatt

SEQ ID NO: 216436 - DNA, 25 bp, E. coli
ggctgaccagcaacaacattggatt

SEQ ID NO: 216437 - DNA, 25 bp, E. coli
tcagcaaagttgtacgaggcacttc

SEQ ID NO: 216438 - DNA, 25 bp, E. coli
tcagcaaagttgaacgaggcacttc

SEQ ID NO: 216439 - DNA, 25 bp, E. coli
gagcttgagatgcaacagaattcac

SEQ ID NO: 216440 - DNA, 25 bp, E. coli
gagcttgagatggaacagaattcac

SEQ ID NO: 216441 - DNA, 25 bp, E. coli
catcttctgcgtcgcttgagatacc

SEQ ID NO: 216442 - DNA, 25 bp, E. coli
catcttctgcgtggcttgagatacc

SEQ ID NO: 216443 - DNA, 25 bp, E. coli
tataacgttggtacttttgagcatc

SEQ ID NO: 216444 - DNA, 25 bp, E. coli
tataacgttggttcttttgagcatc

SEQ ID NO: 216445 - DNA, 25 bp, E. coli
tattttaaaccatagtcatcctaag

SEQ ID NO: 216446 - DNA, 25 bp, E. coli
tattttaaaccaaagtcatcctaag

SEQ ID NO: 216447 - DNA, 25 bp, E. coli
ttttttaccaggcaagcatcgctat

SEQ ID NO: 216448 - DNA, 25 bp, E. coli
ttttttaccagggaagcatcgctat

SEQ ID NO: 216449 - DNA, 25 bp, E. coli
tgtaattctcgaatatctgggagga

SEQ ID NO: 216450 - DNA, 25 bp, E. coli
tgtaattctcgattatctgggagga

SEQ ID NO: 216451 - DNA, 25 bp, E. coli
tgagataccacctaaaagcaattat

SEQ ID NO: 216452 - DNA, 25 bp, E. coli
tgagataccaccaaaaagcaattat

SEQ ID NO: 216453 - DNA, 25 bp, E. coli
tcaggaatgaaaatataaacacggc

SEQ ID NO: 216454 - DNA, 25 bp, E. coli
tcaggaatgaaattataaacacggc

SEQ ID NO: 216455 - DNA, 25 bp, E. coli
gcaagcatcgctataacgttggtac

SEQ ID NO: 216456 - DNA, 25 bp, E. coli
gcaagcatcgctttaacgttggtac

SEQ ID NO: 216457 - DNA, 25 bp, E. coli
gactaggtgtctatttgagaagcaa

SEQ ID NO: 216458 - DNA, 25 bp, E. coli
gactaggtgtctttttgagaagcaa

SEQ ID NO: 216459 - DNA, 25 bp, E. coli
tggactggatatgtcatcttctgcg

SEQ ID NO: 216460 - DNA, 25 bp, E. coli
tggactggatatctcatcttctgcg

SEQ ID NO: 216461 - DNA, 25 bp, E. coli
gatgaacttgactctctttatagca

SEQ ID NO: 216462 - DNA, 25 bp, E. coli
gatgaacttgacactctttatagca

SEQ ID NO: 216463 - DNA, 25 bp, E. coli
aagcctgtattttttatttatcgca

SEQ ID NO: 216464 - DNA, 25 bp, E. coli
aagcctgtatttattatttatcgca

SEQ ID NO: 216465 - DNA, 25 bp, E. coli
cagcggttgtggattatccctgggc

SEQ ID NO: 216466 - DNA, 25 bp, E. coli
cagcggttgtggtttatccctgggc

SEQ ID NO: 216467 - DNA, 25 bp, E. coli
aaaagactggaaaaataagcctgta

SEQ ID NO: 216468 - DNA, 25 bp, E. coli
aaaagactggaataataagcctgta

SEQ ID NO: 216469 - DNA, 25 bp, E. coli
tatccaactgaaaagagactgcttc

SEQ ID NO: 216470 - DNA, 25 bp, E. coli
tatccaactgaatagagactgcttc

SEQ ID NO: 216471 - DNA, 25 bp, E. coli
tatttatcgcaaacgcactttacgg

SEQ ID NO: 216472 - DNA, 25 bp, E. coli
tatttatcgcaatcgcactttacgg

SEQ ID NO: 216473 - DNA, 25 bp, E. coli
ttgagttttccgagtgaatggtgca

SEQ ID NO: 216474 - DNA, 25 bp, E. coli
ttgagttttccgtgtgaatggtgca

SEQ ID NO: 216475 - DNA, 25 bp, E. coli
gcactttacggtattatccaactga

SEQ ID NO: 216476 - DNA, 25 bp, E. coli
gcactttacggttttatccaactga

SEQ ID NO: 216477 - DNA, 25 bp, E. coli
gaatggtgcattatactaaccgagc

SEQ ID NO: 216478 - DNA, 25 bp, E. coli
gaatggtgcattttactaaccgagc

SEQ ID NO: 216479 - DNA, 25 bp, E. coli
gaaaagagactggttccagcggttg

SEQ ID NO: 216480 - DNA, 25 bp, E. coli
gaaaagagactgcttccagcggttg

SEQ ID NO: 216481 - DNA, 25 bp, E. coli
taaccgagccatatgaatcaaccaa

SEQ ID NO: 216482 - DNA, 25 bp, E. coli
taaccgagccatttgaatcaaccaa

SEQ ID NO: 216483 - DNA, 25 bp, E. coli
tcaaccaacgcaataaaaaagactg

SEQ ID NO: 216484 - DNA, 25 bp, E. coli
tcaaccaacgcattaaaaaagactg

SEQ ID NO: 216485 - DNA, 25 bp, E. coli
aatgggatcggcctcgtggatctca

SEQ ID NO: 216486 - DNA, 25 bp, E. coli
aatgggatcggcgtcgtggatctca

SEQ ID NO: 216487 - DNA, 25 bp, E. coli
cactgaatgggatcggcctcgtgga

SEQ ID NO: 216488 - DNA, 25 bp, E. coli
cactgaatgggaacggcctcgtgga

SEQ ID NO: 216489 - DNA, 25 bp, E. coli
aacctgccactgaatgggatcggcc

SEQ ID NO: 216490 - DNA, 25 bp, E. coli
aacagccgctttctccagggcagag

SEQ ID NO: 216491 - DNA, 25 bp, E. coli
aacagccgctttgtccagggcagag

SEQ ID NO: 216492 - DNA, 25 bp, E. coli
aacctgccactgtatgggatcggcc

SEQ ID NO: 216493 - DNA, 25 bp, E. coli
tatcaacaaaatgcggtgacgggtg

SEQ ID NO: 216494 - DNA, 25 bp, E. coli
tatcaacaaaatccggtgacgggtg

SEQ ID NO: 216495 - DNA, 25 bp, E. coli
ttctccagggcagagttacgacatc

SEQ ID NO: 216496 - DNA, 25 bp, E. coli
ttctccagggcacagttacgacatc

SEQ ID NO: 216497 - DNA, 25 bp, E. coli
tgctctggttcgacgccactttccg

SEQ ID NO: 216498 - DNA, 25 bp, E. coli
tgctctggttcgtcgccactttccg

SEQ ID NO: 216499 - DNA, 25 bp, E. coli
tccggtgacgggtgggctgattttt

SEQ ID NO: 216500 - DNA, 25 bp, E. coli
tccggtgacgggagggctgattttt

SEQ ID NO: 216501 - DNA, 25 bp, E. coli
tcgttatcaacataatccggtgacg

SEQ ID NO: 216502 - DNA, 25 bp, E. coli
tcgttatcaacaaaatccggtgacg

SEQ ID NO: 216503 - DNA, 25 bp, E. coli
gccgctttctcctgggcagagttac

SEQ ID NO: 216504 - DNA, 25 bp, E. coli
gccgctttctccagggcagagttac

SEQ ID NO: 216505 - DNA, 25 bp, E. coli
gaaaacctgccagtgaatgggatcg

SEQ ID NO: 216506 - DNA, 25 bp, E. coli
gaaaacctgccactgaatgggatcg

SEQ ID NO: 216507 - DNA, 25 bp, E. coli
aagtggtgcaccagtacggcattga

SEQ ID NO: 216508 - DNA, 25 bp, E. coli
aagtggtgcacctgtacggcattga

SEQ ID NO: 216509 - DNA, 25 bp, E. coli
cacctttagccgaagtgctcgccag

SEQ ID NO: 216510 - DNA, 25 bp, E. coli
cacctttagccgtagtgctcgccag

SEQ ID NO: 216511 - DNA, 25 bp, E. coli
aaattaatgtctgccagatggcggg

SEQ ID NO: 216512 - DNA, 25 bp, E. coli
aaattaatgtctcccagatggcggg

SEQ ID NO: 216513 - DNA, 25 bp, E. coli
tttagcgcgcgtggcaagcattgag

SEQ ID NO: 216514 - DNA, 25 bp, E. coli
tttagcgcgcgtcgcaagcattgag

SEQ ID NO: 216515 - DNA, 25 bp, E. coli
tgttgtcaggcatttaaagccgggt

SEQ ID NO: 216516 - DNA, 25 bp, E. coli
tgttgtcaggcaattaaagccgggt

SEQ ID NO: 216517 - DNA, 25 bp, E. coli
tgacgcttgaagactgcgggccgat

SEQ ID NO: 216518 - DNA, 25 bp, E. coli
tgacgcttgaagtctgcgggccgat

SEQ ID NO: 216519 - DNA, 25 bp, E. coli
tgctggtcgcgcctgaaaagcgtaa

SEQ ID NO: 216520 - DNA, 25 bp, E. coli
tgctggtcgcgcgtgaaaagcgtaa

SEQ ID NO: 216521 - DNA, 25 bp, E. coli
tcgcaaacggcaggcggtaaagcgc

SEQ ID NO: 216522 - DNA, 25 bp, E. coli
tcgcaaacggcacgcggtaaagcgc

SEQ ID NO: 216523 - DNA, 25 bp, E. coli
gcgaaatattgcgtgcgccattaaa

SEQ ID NO: 216524 - DNA, 25 bp, E. coli
gcgaaatattgcctgcgccattaaa

SEQ ID NO: 216525 - DNA, 25 bp, E. coli
gaagattgtcattgcgccagactct

SEQ ID NO: 216526 - DNA, 25 bp, E. coli
gaagattgtcatagcgccagactct

SEQ ID NO: 216527 - DNA, 25 bp, E. coli
cgggcggcaacatcgtgacgcttga

SEQ ID NO: 216528 - DNA, 25 bp, E. coli
cgggcggcaacaacgtgacgcttga

SEQ ID NO: 216529 - DNA, 25 bp, E. coli
catgatgacgcaacccactgatgtg

SEQ ID NO: 216530 - DNA, 25 bp, E. coli
catgatgacgcatcccactgatgtg

SEQ ID NO: 216531 - DNA, 25 bp, E. coli
tacaccgtattttcaggcgagcggc

SEQ ID NO: 216532 - DNA, 25 bp, E. coli
tacaccgtatttacaggcgagcggc

SEQ ID NO: 216533 - DNA, 25 bp, E. coli
tatgaatctggatagtgctcacgca

SEQ ID NO: 216534 - DNA, 25 bp, E. coli
tatggaactggccttcgaagaagcg

SEQ ID NO: 216535 - DNA, 25 bp, E. coli
tatgaatctggaaagtgctcacgca

SEQ ID NO: 216536 - DNA, 25 bp, E. coli
tatggaactggcgttcgaagaagcg

SEQ ID NO: 216537 - DNA, 25 bp, E. coli
gaaccgtttatcgtgcagacaggca

SEQ ID NO: 216538 - DNA, 25 bp, E. coli
gaaccgtttatcctgcagacaggca

SEQ ID NO: 216539 - DNA, 25 bp, E. coli
cgcagctctgcgtggaaggtgaact

SEQ ID NO: 216540 - DNA, 25 bp, E. coli
cgcagctctgcgaggaaggtgaact

SEQ ID NO: 216541 - DNA, 25 bp, E. coli
cattacatggcggtagcggtacgcc

SEQ ID NO: 216542 - DNA, 25 bp, E. coli
cattacatggcgctagcggtacgcc

SEQ ID NO: 216543 - DNA, 25 bp, E. coli
cattgaactggtcgacgcgctgaaa

SEQ ID NO: 216544 - DNA, 25 bp, E. coli
cattgaactggtggacgcgctgaaa

SEQ ID NO: 216545 - DNA, 25 bp, E. coli
ggagattttccactgctcgagcgtg

SEQ ID NO: 216546 - DNA, 25 bp, E. coli
ggaatctgcctcagtaccggtcgct

SEQ ID NO: 216547 - DNA, 25 bp, E. coli
ggaatctgcctctgtaccggtcgct

SEQ ID NO: 216548 - DNA, 25 bp, E. coli
ggagattttccagtgctcgagcgtg

SEQ ID NO: 216549 - DNA, 25 bp, E. coli
gatgcttctgcttttcccctggagg

SEQ ID NO: 216550 - DNA, 25 bp, E. coli
gatgcttctgctattcccctggagg

SEQ ID NO: 216551 - DNA, 25 bp, E. coli
catctgcagggtatgacggttccgg

SEQ ID NO: 216552 - DNA, 25 bp, E. coli
catctgcagggtttgacggttccgg

SEQ ID NO: 216553 - DNA, 25 bp, E. coli
tatgaaggagaaaagtgctgcccgc

SEQ ID NO: 216554 - DNA, 25 bp, E. coli
tatgaaggagaatagtgctgcccgc

SEQ ID NO: 216555 - DNA, 25 bp, E. coli
tatatggcgaatgacagcaaaggcc

SEQ ID NO: 216556 - DNA, 25 bp, E. coli
ttgaacatgacctgatgactgtcgc

SEQ ID NO: 216557 - DNA, 25 bp, E. coli
tatatggcgaatcacagcaaaggcc

SEQ ID NO: 216558 - DNA, 25 bp, E. coli
tttgttacggcgtaagaagcagcga

SEQ ID NO: 216559 - DNA, 25 bp, E. coli
ttgaacatgaccagatgactgtcgc

SEQ ID NO: 216560 - DNA, 25 bp, E. coli
tttgttacggcgaaagaagcagcga

SEQ ID NO: 216561 - DNA, 25 bp, E. coli
tgactgtcgctgagaaaatcctgct

SEQ ID NO: 216562 - DNA, 25 bp, E. coli
tgactgtcgctgtgaaaatcctgct

SEQ ID NO: 216563 - DNA, 25 bp, E. coli
gcaatgacggacaaccaccgtggtt

SEQ ID NO: 216564 - DNA, 25 bp, E. coli
gcaatgacggactaccaccgtggtt

SEQ ID NO: 216565 - DNA, 25 bp, E. coli
gaaaatcctgctccgatgcacctgg

SEQ ID NO: 216566 - DNA, 25 bp, E. coli
gaaaatcctgctgcgatgcacctgg

SEQ ID NO: 216567 - DNA, 25 bp, E. coli
cttgacccggcagagaaagaggccc

SEQ ID NO: 216568 - DNA, 25 bp, E. coli
cttgacccggcacagaaagaggccc

SEQ ID NO: 216569 - DNA, 25 bp, E. coli
tggatgcccgtttacacttcagcgg

SEQ ID NO: 216570 - DNA, 25 bp, E. coli
tggatgcccgttaacacttcagcgg

SEQ ID NO: 216571 - DNA, 25 bp, E. coli
gaggcccgtcgtttgcatctgcagg

SEQ ID NO: 216572 - DNA, 25 bp, E. coli
gaggcccgtcgtatgcatctgcagg

SEQ ID NO: 216573 - DNA, 25 bp, E. coli
cagccgcaatctactcgggtttggg

SEQ ID NO: 216574 - DNA, 25 bp, E. coli
cagccgcaatcttctcgggtttggg

SEQ ID NO: 216575 - DNA, 25 bp, E. coli
cagacgtactgtagagatccacaaa

SEQ ID NO: 216576 - DNA, 25 bp, E. coli
cagacgtactgttgagatccacaaa

SEQ ID NO: 216577 - DNA, 25 bp, E. coli
taaaatttcatcaatacgcacgcgc

SEQ ID NO: 216578 - DNA, 25 bp, E. coli
tacacgaagtggatttgggacctgg

SEQ ID NO: 216579 - DNA, 25 bp, E. coli
tacaggcgtttcaaatgccctcgga

SEQ ID NO: 216580 - DNA, 25 bp, E. coli
tacacgaagtggttttgggacctgg

SEQ ID NO: 216581 - DNA, 25 bp, E. coli
tacaataaagcttacgcgggtgcga

SEQ ID NO: 216582 - DNA, 25 bp, E. coli
tacaggcgtttctaatgccctcgga

SEQ ID NO: 216583 - DNA, 25 bp, E. coli
tacaataaagctaacgcgggtgcga

SEQ ID NO: 216584 - DNA, 25 bp, E. coli
taaaatttcatctatacgcacgcgc

SEQ ID NO: 216585 - DNA, 25 bp, E. coli
tatggtactccagactataccggcc

SEQ ID NO: 216586 - DNA, 25 bp, E. coli
tatggtactccacactataccggcc

SEQ ID NO: 216587 - DNA, 25 bp, E. coli
tataccggccaatcgataggatacg

SEQ ID NO: 216588 - DNA, 25 bp, E. coli
tataccggccaaacgataggatacg

SEQ ID NO: 216589 - DNA, 25 bp, E. coli
tcataattgcgatggcagacgtact

SEQ ID NO: 216590 - DNA, 25 bp, E. coli
tcataattgcgaaggcagacgtact

SEQ ID NO: 216591 - DNA, 25 bp, E. coli
gatacgttgtaagccttcctgccca

SEQ ID NO: 216592 - DNA, 25 bp, E. coli
gatacgttgtaacccttcctgccca

SEQ ID NO: 216593 - DNA, 25 bp, E. coli
gaccaacttcgctctgttacaggcg

SEQ ID NO: 216594 - DNA, 25 bp, E. coli
gaccaacttcgcactgttacaggcg

SEQ ID NO: 216595 - DNA, 25 bp, E. coli
aatgcgggttcgacatctcctccgg

SEQ ID NO: 216596 - DNA, 25 bp, E. coli
aagacgaaaacacggcgcatctgga

SEQ ID NO: 216597 - DNA, 25 bp, E. coli
aatgcgggttcgtcatctcctccgg

SEQ ID NO: 216598 - DNA, 25 bp, E. coli
aagacgaaaacagggcgcatctgga

SEQ ID NO: 216599 - DNA, 25 bp, E. coli
aaaagacgaaaacagggcgcatctg

SEQ ID NO: 216600 - DNA, 25 bp, E. coli
aaaagacgaaaagagggcgcatctg

SEQ ID NO: 216601 - DNA, 25 bp, E. coli
ttcgtcatctcctccggcggtctgg

SEQ ID NO: 216602 - DNA, 25 bp, E. coli
ttcgtcatctccaccggcggtctgg

SEQ ID NO: 216603 - DNA, 25 bp, E. coli
tgaaaaagacgaaaacagggcgcat

SEQ ID NO: 216604 - DNA, 25 bp, E. coli
tgaaaaagacgataacagggcgcat

SEQ ID NO: 216605 - DNA, 25 bp, E. coli
tcgcaatgcgggttcgtcatctcct

SEQ ID NO: 216606 - DNA, 25 bp, E. coli
tcgcaatgcgggatcgtcatctcct

SEQ ID NO: 216607 - DNA, 25 bp, E. coli
taaaggtactggcaccgggcctgaa

SEQ ID NO: 216608 - DNA, 25 bp, E. coli
taaaggtactgggaccgggcctgaa

SEQ ID NO: 216609 - DNA, 25 bp, E. coli
cgacacaccggttaaggtactggca

SEQ ID NO: 216610 - DNA, 25 bp, E. coli
cgacacaccggtaaaggtactggca

SEQ ID NO: 216611 - DNA, 25 bp, E. coli
cgggttcgtcatgtcctccggcggt

SEQ ID NO: 216612 - DNA, 25 bp, E. coli
cgggttcgtcatctcctccggcggt

SEQ ID NO: 216613 - DNA, 25 bp, E. coli
ggatgatcgcaatgcgggttcgtca

SEQ ID NO: 216614 - DNA, 25 bp, E. coli
ggatgatcgcaaagcgggttcgtca

SEQ ID NO: 216615 - DNA, 25 bp, E. coli
tggcaccgggccagaaaaagacgaa

SEQ ID NO: 216616 - DNA, 25 bp, E. coli
tggcaccgggcctgaaaaagacgaa

SEQ ID NO: 216617 - DNA, 25 bp, E. coli
catttccgggctcgcagaaattctt

SEQ ID NO: 216618 - DNA, 25 bp, E. coli
catttccgggctggcagaaattctt

SEQ ID NO: 216619 - DNA, 25 bp, E. coli
aggcccggtttaggctgcaacagga

SEQ ID NO: 216620 - DNA, 25 bp, E. coli
aggcccggtttacgctgcaacagga

SEQ ID NO: 216621 - DNA, 25 bp, E. coli
tataaggagttgacgatgtcagtac

SEQ ID NO: 216622 - DNA, 25 bp, E. coli
tataaggagttgtcgatgtcagtac

SEQ ID NO: 216623 - DNA, 25 bp, E. coli
ttcctgccgcattagccgccgaagg

SEQ ID NO: 216624 - DNA, 25 bp, E. coli
ttcctgccgcataagccgccgaagg

SEQ ID NO: 216625 - DNA, 25 bp, E. coli
tgcaggcccggtttacgctgcaaca

SEQ ID NO: 216626 - DNA, 25 bp, E. coli
tgcaggcccggtatacgctgcaaca

SEQ ID NO: 216627 - DNA, 25 bp, E. coli
gctgcaacaggatcgaaacgtaccg

SEQ ID NO: 216628 - DNA, 25 bp, E. coli
gctgcaacaggaacgaaacgtaccg

SEQ ID NO: 216629 - DNA, 25 bp, E. coli
gcaacaggatcgtaacgtaccgcga

SEQ ID NO: 216630 - DNA, 25 bp, E. coli
gcaacaggatcgaaacgtaccgcga

SEQ ID NO: 216631 - DNA, 25 bp, E. coli
cggtttacgctgcaacaggatcgaa

SEQ ID NO: 216632 - DNA, 25 bp, E. coli
cggtttacgctggaacaggatcgaa

SEQ ID NO: 216633 - DNA, 25 bp, E. coli
ggagttgtcgatctcagtacctctc

SEQ ID NO: 216634 - DNA, 25 bp, E. coli
ggagttgtcgatgtcagtacctctc

SEQ ID NO: 216635 - DNA, 25 bp, E. coli
tgtgggcgggcaattccgggctggc

SEQ ID NO: 216636 - DNA, 25 bp, E. coli
tgtgggcgggcatttccgggctggc

SEQ ID NO: 216637 - DNA, 25 bp, E. coli
gatcgaaacgtaccgcgattctgtg

SEQ ID NO: 216638 - DNA, 25 bp, E. coli
gatcgaaacgtagcgcgattctgtg

SEQ ID NO: 216639 - DNA, 25 bp, E. coli
caatggcaggctaaaatgtcgaacg

SEQ ID NO: 216640 - DNA, 25 bp, E. coli
caatggcaggcttaaatgtcgaacg

SEQ ID NO: 216641 - DNA, 25 bp, E. coli
cactgaagcggtcattagcgttccc

SEQ ID NO: 216642 - DNA, 25 bp, E. coli
caaagtgaactgttccccaatgcgt

SEQ ID NO: 216643 - DNA, 25 bp, E. coli
caaagtgaactgatccccaatgcgt

SEQ ID NO: 216644 - DNA, 25 bp, E. coli
cactgaagcggtgattagcgttccc

SEQ ID NO: 216645 - DNA, 25 bp, E. coli
ttaattaacgaaccaaccgccgctg

SEQ ID NO: 216646 - DNA, 25 bp, E. coli
tattcaggcagcacttaaagcgcgg

SEQ ID NO: 216647 - DNA, 25 bp, E. coli
ttaattaacgaagcaaccgccgctg

SEQ ID NO: 216648 - DNA, 25 bp, E. coli
tatctactcgagtagcaggatcctg

SEQ ID NO: 216649 - DNA, 25 bp, E. coli
tatctactcgagaagcaggatcctg

SEQ ID NO: 216650 - DNA, 25 bp, E. coli
tattgaatggcgagaaccgacactc

SEQ ID NO: 216651 - DNA, 25 bp, E. coli
tattatggaagtacgtgccagtgcc

SEQ ID NO: 216652 - DNA, 25 bp, E. coli
tattatggaagttcgtgccagtgcc

SEQ ID NO: 216653 - DNA, 25 bp, E. coli
tattgaatggcgtgaaccgacactc

SEQ ID NO: 216654 - DNA, 25 bp, E. coli
tattcaggcagctcttaaagcgcgg

SEQ ID NO: 216655 - DNA, 25 bp, E. coli
gaatccatatgccactggagcgggc

SEQ ID NO: 216656 - DNA, 25 bp, E. coli
gaatccatatgcgactggagcgggc

SEQ ID NO: 216657 - DNA, 25 bp, E. coli
cgcgatgaacagttaaaccaggcct

SEQ ID NO: 216658 - DNA, 25 bp, E. coli
cgcgatgaacagataaaccaggcct

SEQ ID NO: 216659 - DNA, 25 bp, E. coli
gatgtcgatatcagcgtgccactga

SEQ ID NO: 216660 - DNA, 25 bp, E. coli
gatgtcgatatctgcgtgccactga

SEQ ID NO: 216661 - DNA, 25 bp, E. coli
aatccagagggcctcgggcaattaa

SEQ ID NO: 216662 - DNA, 25 bp, E. coli
aatccagagggcgtcgggcaattaa

SEQ ID NO: 216663 - DNA, 25 bp, E. coli
caaatacgccctcggaaaatccaga

SEQ ID NO: 216664 - DNA, 25 bp, E. coli
caaatacgccctgggaaaatccaga

SEQ ID NO: 216665 - DNA, 25 bp, E. coli
caaaatttcgcacaggatcgcgctg

SEQ ID NO: 216666 - DNA, 25 bp, E. coli
caaaatttcgcagaggatcgcgctg

SEQ ID NO: 216667 - DNA, 25 bp, E. coli
caggatcgcgctgtggctaatggat

SEQ ID NO: 216668 - DNA, 25 bp, E. coli
caggatcgcgctctggctaatggat

SEQ ID NO: 216669 - DNA, 25 bp, E. coli
ttaaaaggtaacttgacaatgcatg

SEQ ID NO: 216670 - DNA, 25 bp, E. coli
ttaaaaggtaacatgacaatgcatg

SEQ ID NO: 216671 - DNA, 25 bp, E. coli
gcaattaaaccggtgttagccgatt

SEQ ID NO: 216672 - DNA, 25 bp, E. coli
gcaattaaaccgctgttagccgatt

SEQ ID NO: 216673 - DNA, 25 bp, E. coli
gacatagaaacatatacgccctcgg

SEQ ID NO: 216674 - DNA, 25 bp, E. coli
gacatagaaacaaatacgccctcgg

SEQ ID NO: 216675 - DNA, 25 bp, E. coli
gttatgtaatgtggaggaagatcac

SEQ ID NO: 216676 - DNA, 25 bp, E. coli
gttatgtaatgtcgaggaagatcac

SEQ ID NO: 216677 - DNA, 25 bp, E. coli
gggcaagaaggagatagaaacaaat

SEQ ID NO: 216678 - DNA, 25 bp, E. coli
gtgttagccgatatctgtcagagac

SEQ ID NO: 216679 - DNA, 25 bp, E. coli
gtgttagccgatttctgtcagagac

SEQ ID NO: 216680 - DNA, 25 bp, E. coli
gggcaagaaggacatagaaacaaat

SEQ ID NO: 216681 - DNA, 25 bp, E. coli
ggaagatcacaatatttcgcacagg

SEQ ID NO: 216682 - DNA, 25 bp, E. coli
ggaagatcacaaaatttcgcacagg

SEQ ID NO: 216683 - DNA, 25 bp, E. coli
ctacagcagttaccggacaaaaacg

SEQ ID NO: 216684 - DNA, 25 bp, E. coli
ctacagcagttagcggacaaaaacg

SEQ ID NO: 216685 - DNA, 25 bp, E. coli
acggcggcagaaccctgtattttga

SEQ ID NO: 216686 - DNA, 25 bp, E. coli
acggcggcagaagcctgtattttga

SEQ ID NO: 216687 - DNA, 25 bp, E. coli
tatccgcttacacctgcgcgataac

SEQ ID NO: 216688 - DNA, 25 bp, E. coli
tatccgcttacagctgcgcgataac

SEQ ID NO: 216689 - DNA, 25 bp, E. coli
tgtttcccggtgaggacggttacag

SEQ ID NO: 216690 - DNA, 25 bp, E. coli
tgtattttgagctcctgtttcccgg

SEQ ID NO: 216691 - DNA, 25 bp, E. coli
tgtttcccggtgtggacggttacag

SEQ ID NO: 216692 - DNA, 25 bp, E. coli
tgtattttgagcacctgtttcccgg

SEQ ID NO: 216693 - DNA, 25 bp, E. coli
tcggtgcaaaggtccttcccggtga

SEQ ID NO: 216694 - DNA, 25 bp, E. coli
tcggtgcaaaggaccttcccggtga

SEQ ID NO: 216695 - DNA, 25 bp, E. coli
tgcgcgataacacactgatactcag

SEQ ID NO: 216696 - DNA, 25 bp, E. coli
tgcgcgataacagactgatactcag

SEQ ID NO: 216697 - DNA, 25 bp, E. coli
gacatgacgcagaatggcggtagca

SEQ ID NO: 216698 - DNA, 25 bp, E. coli
gacatgacgcagtatggcggtagca

SEQ ID NO: 216699 - DNA, 25 bp, E. coli
gatactcagtgaaaacggcggcaga

SEQ ID NO: 216700 - DNA, 25 bp, E. coli
gatactcagtgataacggcggcaga

SEQ ID NO: 216701 - DNA, 25 bp, E. coli
tggcgaaactggttgaaggtcaccg

SEQ ID NO: 216702 - DNA, 25 bp, E. coli
tggaaaatgcctgcggatatccgct

SEQ ID NO: 216703 - DNA, 25 bp, E. coli
tggcgaaactggatgaaggtcaccg

SEQ ID NO: 216704 - DNA, 25 bp, E. coli
tggaaaatgcctccggatatccgct

SEQ ID NO: 216705 - DNA, 25 bp, E. coli
cagttatctggaatggcgcgcagga

SEQ ID NO: 216706 - DNA, 25 bp, E. coli
cagttatctggattggcgcgcagga

SEQ ID NO: 216707 - DNA, 25 bp, E. coli
taccacctcggctgtaaagggccag

SEQ ID NO: 216708 - DNA, 25 bp, E. coli
tacggaatctctccttcgtgcaacg

SEQ ID NO: 216709 - DNA, 25 bp, E. coli
tacggaatctctgcttcgtgcaacg

SEQ ID NO: 216710 - DNA, 25 bp, E. coli
taccacctcggcagtaaagggccag

SEQ ID NO: 216711 - DNA, 25 bp, E. coli
tattgcatggttgccggtgagccga

SEQ ID NO: 216712 - DNA, 25 bp, E. coli
tattgcatggttcccggtgagccga

SEQ ID NO: 216713 - DNA, 25 bp, E. coli
tgtggatcacatccgcaaagcggcg

SEQ ID NO: 216714 - DNA, 25 bp, E. coli
tgtggatcacatgcgcaaagcggcg

SEQ ID NO: 216715 - DNA, 25 bp, E. coli
gctctcgagaagaacaaagggcagt

SEQ ID NO: 216716 - DNA, 25 bp, E. coli
gctctcgagaagtacaaagggcagt

SEQ ID NO: 216717 - DNA, 25 bp, E. coli
gaagctttgtgcagcattagccgcc

SEQ ID NO: 216718 - DNA, 25 bp, E. coli
gaagctttgtgctgcattagccgcc

SEQ ID NO: 216719 - DNA, 25 bp, E. coli
cgctgcagagatggccgaatcggtt

SEQ ID NO: 216720 - DNA, 25 bp, E. coli
cgctgcagagatcgccgaatcggtt

SEQ ID NO: 216721 - DNA, 25 bp, E. coli
gggttaagtagcaaagccgctgcag

SEQ ID NO: 216722 - DNA, 25 bp, E. coli
gggttaagtagctaagccgctgcag

SEQ ID NO: 216723 - DNA, 25 bp, E. coli
ggagttaacccaactggcgcagtca

SEQ ID NO: 216724 - DNA, 25 bp, E. coli
ggagttaacccatctggcgcagtca

SEQ ID NO: 216725 - DNA, 25 bp, E. coli
gagtatcacgaactgctttccgccg

SEQ ID NO: 216726 - DNA, 25 bp, E. coli
gagtatcacgaagtgctttccgccg

SEQ ID NO: 216727 - DNA, 25 bp, E. coli
caccgggcgtattgtgcaacaggca

SEQ ID NO: 216728 - DNA, 25 bp, E. coli
caccgggcgtatagtgcaacaggca

SEQ ID NO: 216729 - DNA, 25 bp, E. coli
tatgcggcggcgaatcaatgccagt

SEQ ID NO: 216730 - DNA, 25 bp, E. coli
tatgcggcggcgtatcaatgccagt

SEQ ID NO: 216731 - DNA, 25 bp, E. coli
tttatcttgaagtgccatgggcgca

SEQ ID NO: 216732 - DNA, 25 bp, E. coli
tttatcttgaagagccatgggcgca

SEQ ID NO: 216733 - DNA, 25 bp, E. coli
tgttgaaaagcgcagcactaccgtg

SEQ ID NO: 216734 - DNA, 25 bp, E. coli
tgtttacggctttcggcgcacgagt

SEQ ID NO: 216735 - DNA, 25 bp, E. coli
tgtttacggcttacggcgcacgagt

SEQ ID NO: 216736 - DNA, 25 bp, E. coli
tgttgaaaagcggagcactaccgtg

SEQ ID NO: 216737 - DNA, 25 bp, E. coli
tgagcatcatggtgaaggcgacgtc

SEQ ID NO: 216738 - DNA, 25 bp, E. coli
tgagcatcatggagaaggcgacgtc

SEQ ID NO: 216739 - DNA, 25 bp, E. coli
gctggaagttccacaacctgatgaa

SEQ ID NO: 216740 - DNA, 25 bp, E. coli
gctggaagttcctcaacctgatgaa

SEQ ID NO: 216741 - DNA, 25 bp, E. coli
cttaccgggtatgggcaaagatcgc

SEQ ID NO: 216742 - DNA, 25 bp, E. coli
ctatatcaatgaacagtgccaggga

SEQ ID NO: 216743 - DNA, 25 bp, E. coli
cttaccgggtatcggcaaagatcgc

SEQ ID NO: 216744 - DNA, 25 bp, E. coli
ctatatcaatgatcagtgccaggga

SEQ ID NO: 216745 - DNA, 25 bp, E. coli
gattccgcacgcaggcattacctga

SEQ ID NO: 216746 - DNA, 25 bp, E. coli
gattccgcacgctggcattacctga

SEQ ID NO: 216747 - DNA, 25 bp, E. coli
tggaagcagcaaaatgccagacgcg

SEQ ID NO: 216748 - DNA, 25 bp, E. coli
tggaagcagcaatatgccagacgcg

SEQ ID NO: 216749 - DNA, 25 bp, E. coli
tattattctagatccatgcgggcga

SEQ ID NO: 216750 - DNA, 25 bp, E. coli
tattattctagaaccatgcgggcga

SEQ ID NO: 216751 - DNA, 25 bp, E. coli
tgcggcagaccacgttatagctaaa

SEQ ID NO: 216752 - DNA, 25 bp, E. coli
tgcggcagaccaggttatagctaaa

SEQ ID NO: 216753 - DNA, 25 bp, E. coli
tcgatatacattccccttggcgcag

SEQ ID NO: 216754 - DNA, 25 bp, E. coli
tctgagtcagcgttggtagccgcca

SEQ ID NO: 216755 - DNA, 25 bp, E. coli
tcgatatacattgcccttggcgcag

SEQ ID NO: 216756 - DNA, 25 bp, E. coli
tctgagtcagcgatggtagccgcca

SEQ ID NO: 216757 - DNA, 25 bp, E. coli
gaactatctgtagcgcttcaagggc

SEQ ID NO: 216758 - DNA, 25 bp, E. coli
gaactatctgtaccgcttcaagggc

SEQ ID NO: 216759 - DNA, 25 bp, E. coli
gaaaagcctaatggtgaaaccgcag

SEQ ID NO: 216760 - DNA, 25 bp, E. coli
gactttgctacgactttcaggccta

SEQ ID NO: 216761 - DNA, 25 bp, E. coli
gactttgctacgtctttcaggccta

SEQ ID NO: 216762 - DNA, 25 bp, E. coli
gaaaagcctaatcgtgaaaccgcag

SEQ ID NO: 216763 - DNA, 25 bp, E. coli
cattggatcgtgctttctggtacag

SEQ ID NO: 216764 - DNA, 25 bp, E. coli
cgtatagtcttgagaatccgggcat

SEQ ID NO: 216765 - DNA, 25 bp, E. coli
cgtatagtcttgtgaatccgggcat

SEQ ID NO: 216766 - DNA, 25 bp, E. coli
cattggatcgtggtttctggtacag

SEQ ID NO: 216767 - DNA, 25 bp, E. coli
ggtacagcaaaactaacccttggcg

SEQ ID NO: 216768 - DNA, 25 bp, E. coli
ggtacagcaaaagtaacccttggcg

SEQ ID NO: 216769 - DNA, 25 bp, E. coli
taattgctgtagttatggccggtgg

SEQ ID NO: 216770 - DNA, 25 bp, E. coli
taattgctgtagatatggccggtgg

SEQ ID NO: 216771 - DNA, 25 bp, E. coli
aactgacctggctattacgctgcaa

SEQ ID NO: 216772 - DNA, 25 bp, E. coli
aactgacctggcaattacgctgcaa

SEQ ID NO: 216773 - DNA, 25 bp, E. coli
aaactggaacaacctcttcctgcgg

SEQ ID NO: 216774 - DNA, 25 bp, E. coli
aaactggaacaagctcttcctgcgg

SEQ ID NO: 216775 - DNA, 25 bp, E. coli
tatcgccgaagatttcaccctgttg

SEQ ID NO: 216776 - DNA, 25 bp, E. coli
tatggaagagacaatacaacggagt

SEQ ID NO: 216777 - DNA, 25 bp, E. coli
tatggaagagactatacaacggagt

SEQ ID NO: 216778 - DNA, 25 bp, E. coli
tatcgccgaagaattcaccctgttg

SEQ ID NO: 216779 - DNA, 25 bp, E. coli
tagtcgctctgtgatctgcatgccg

SEQ ID NO: 216780 - DNA, 25 bp, E. coli
tagtcgctctgtcatctgcatgccg

SEQ ID NO: 216781 - DNA, 25 bp, E. coli
tgtgcccaccgatctgtacgattta

SEQ ID NO: 216782 - DNA, 25 bp, E. coli
tgtgcccaccgaactgtacgattta

SEQ ID NO: 216783 - DNA, 25 bp, E. coli
gctgaaaatgccgaagaactgttgg

SEQ ID NO: 216784 - DNA, 25 bp, E. coli
gctgcaaccagttattagtcgctct

SEQ ID NO: 216785 - DNA, 25 bp, E. coli
gctgaaaatgcccaagaactgttgg

SEQ ID NO: 216786 - DNA, 25 bp, E. coli
gctgcaaccagtaattagtcgctct

SEQ ID NO: 216787 - DNA, 25 bp, E. coli
gacttattaggctttgtgcccaccg

SEQ ID NO: 216788 - DNA, 25 bp, E. coli
gacttattaggcattgtgcccaccg

SEQ ID NO: 216789 - DNA, 25 bp, E. coli
taacgccctctgctgttagtcagtc

SEQ ID NO: 216790 - DNA, 25 bp, E. coli
tcagcattagtaaagcggcagaatc

SEQ ID NO: 216791 - DNA, 25 bp, E. coli
tcagcattagtatagcggcagaatc

SEQ ID NO: 216792 - DNA, 25 bp, E. coli
taacgccctctggtgttagtcagtc

SEQ ID NO: 216793 - DNA, 25 bp, E. coli
caagcctagcgggagttgtttacgc

SEQ ID NO: 216794 - DNA, 25 bp, E. coli
caagcctagcggcagttgtttacgc

SEQ ID NO: 216795 - DNA, 25 bp, E. coli
caaacgaacgttttagcaggactgt

SEQ ID NO: 216796 - DNA, 25 bp, E. coli
caaagcatggcgttttgttgcgcgg

SEQ ID NO: 216797 - DNA, 25 bp, E. coli
caaagcatggcgatttgttgcgcgg

SEQ ID NO: 216798 - DNA, 25 bp, E. coli
caaacgaacgttatagcaggactgt

SEQ ID NO: 216799 - DNA, 25 bp, E. coli
catctgcgagcaaagcatggcgttt

SEQ ID NO: 216800 - DNA, 25 bp, E. coli
catctgcgagcatagcatggcgttt

SEQ ID NO: 216801 - DNA, 25 bp, E. coli
tagcaggactgtcgtcggttgccaa

SEQ ID NO: 216802 - DNA, 25 bp, E. coli
taggaaaaatgaaatcaaacgaacg

SEQ ID NO: 216803 - DNA, 25 bp, E. coli
tagcaggactgtggtcggttgccaa

SEQ ID NO: 216804 - DNA, 25 bp, E. coli
taggaaaaatgatatcaaacgaacg

SEQ ID NO: 216805 - DNA, 25 bp, E. coli
tattcgcgcgttaattaaaatcagg

SEQ ID NO: 216806 - DNA, 25 bp, E. coli
tattcgcgcgtttattaaaatcagg

SEQ ID NO: 216807 - DNA, 25 bp, E. coli
tgttttcaacgggactctcccgctg

SEQ ID NO: 216808 - DNA, 25 bp, E. coli
tgttgcgcgggatcagcaagcctag

SEQ ID NO: 216809 - DNA, 25 bp, E. coli
tgttttcaacggcactctcccgctg

SEQ ID NO: 216810 - DNA, 25 bp, E. coli
tgttgcgcgggaacagcaagcctag

SEQ ID NO: 216811 - DNA, 25 bp, E. coli
gtcggttgccaaccatctgcgagca

SEQ ID NO: 216812 - DNA, 25 bp, E. coli
gggactctcccggtgaatattcgcg

SEQ ID NO: 216813 - DNA, 25 bp, E. coli
gggactctcccgctgaatattcgcg

SEQ ID NO: 216814 - DNA, 25 bp, E. coli
gtcggttgccaagcatctgcgagca

SEQ ID NO: 216815 - DNA, 25 bp, E. coli
caaagcagaatgcaaggctaatcca

SEQ ID NO: 216816 - DNA, 25 bp, E. coli
caaagcagaatggaaggctaatcca

SEQ ID NO: 216817 - DNA, 25 bp, E. coli
cagaatggaaggctaatccacaaca

SEQ ID NO: 216818 - DNA, 25 bp, E. coli
cagaatggaagggtaatccacaaca

SEQ ID NO: 216819 - DNA, 25 bp, E. coli
cataaatggctacctgccggttcgt

SEQ ID NO: 216820 - DNA, 25 bp, E. coli
cataaatggctagctgccggttcgt

SEQ ID NO: 216821 - DNA, 25 bp, E. coli
taaatggctaccagccggttcgtta

SEQ ID NO: 216822 - DNA, 25 bp, E. coli
taaatggctacctgccggttcgtta

SEQ ID NO: 216823 - DNA, 25 bp, E. coli
tatggtgtcggcatgaatattgcgt

SEQ ID NO: 216824 - DNA, 25 bp, E. coli
tatggtgtcggcttgaatattgcgt

SEQ ID NO: 216825 - DNA, 25 bp, E. coli
tatcataaatggctacctgccggtt

SEQ ID NO: 216826 - DNA, 25 bp, E. coli
tatcataaatgggtacctgccggtt

SEQ ID NO: 216827 - DNA, 25 bp, E. coli
tgaagattttttccgtccgacagac

SEQ ID NO: 216828 - DNA, 25 bp, E. coli
tgaagattttttgcgtccgacagac

SEQ ID NO: 216829 - DNA, 25 bp, E. coli
tcggcatgaataatgcgtggagatt

SEQ ID NO: 216830 - DNA, 25 bp, E. coli
tcggcatgaatattgcgtggagatt

SEQ ID NO: 216831 - DNA, 25 bp, E. coli
gaatattgcgtggagatttgagtaa

SEQ ID NO: 216832 - DNA, 25 bp, E. coli
gaatattgcgtgcagatttgagtaa

SEQ ID NO: 216833 - DNA, 25 bp, E. coli
ggctaatccacaacaagcgcctcgt

SEQ ID NO: 216834 - DNA, 25 bp, E. coli
ggctaatccacatcaagcgcctcgt

SEQ ID NO: 216835 - DNA, 25 bp, E. coli
ggaaggctaatcgacaacaagcgcc

SEQ ID NO: 216836 - DNA, 25 bp, E. coli
ggaaggctaatccacaacaagcgcc

SEQ ID NO: 216837 - DNA, 25 bp, E. coli
cagtattacttacccagccgggtgc

SEQ ID NO: 216838 - DNA, 25 bp, E. coli
cagtattacttagccagccgggtgc

SEQ ID NO: 216839 - DNA, 25 bp, E. coli
atcaggaagaccctcgcggagaacc

SEQ ID NO: 216840 - DNA, 25 bp, E. coli
atcaggaagaccgtcgcggagaacc

SEQ ID NO: 216841 - DNA, 25 bp, E. coli
aagaccctcgcggagaacctgaaag

SEQ ID NO: 216842 - DNA, 25 bp, E. coli
aagaccctcgcgcagaacctgaaag

SEQ ID NO: 216843 - DNA, 25 bp, E. coli
tagccagccgggagctggctttttt

SEQ ID NO: 216844 - DNA, 25 bp, E. coli
tagccagccgggtgctggctttttt

SEQ ID NO: 216845 - DNA, 25 bp, E. coli
tattacttagccagccgggtgctgg

SEQ ID NO: 216846 - DNA, 25 bp, E. coli
tattacttagcctgccgggtgctgg

SEQ ID NO: 216847 - DNA, 25 bp, E. coli
tgctcacattgcttccagtattact

SEQ ID NO: 216848 - DNA, 25 bp, E. coli
tgaaagcacgactttgctcacattg

SEQ ID NO: 216849 - DNA, 25 bp, E. coli
tgaaagcacgacattgctcacattg

SEQ ID NO: 216850 - DNA, 25 bp, E. coli
tgctcacattgcatccagtattact

SEQ ID NO: 216851 - DNA, 25 bp, E. coli
tccagtattactaagccagccgggt

SEQ ID NO: 216852 - DNA, 25 bp, E. coli
tccagtattacttagccagccgggt

SEQ ID NO: 216853 - DNA, 25 bp, E. coli
cctcgcggagaagctgaaagcacga

SEQ ID NO: 216854 - DNA, 25 bp, E. coli
cctcgcggagaacctgaaagcacga

SEQ ID NO: 216855 - DNA, 25 bp, E. coli
gacattgctcacattgcttccagta

SEQ ID NO: 216856 - DNA, 25 bp, E. coli
gacattgctcactttgcttccagta

SEQ ID NO: 216857 - DNA, 25 bp, E. coli
ggagaacctgaaagcacgacattgc

SEQ ID NO: 216858 - DNA, 25 bp, E. coli
ggagaacctgaatgcacgacattgc

SEQ ID NO: 216859 - DNA, 25 bp, E. coli
tatgaacccggatacgaacagtatc

SEQ ID NO: 216860 - DNA, 25 bp, E. coli
tatctttcttatcgttgccattggc

SEQ ID NO: 216861 - DNA, 25 bp, E. coli
tatgaacccggaaacgaacagtatc

SEQ ID NO: 216862 - DNA, 25 bp, E. coli
tattggcgcgctcgactggacgccc

SEQ ID NO: 216863 - DNA, 25 bp, E. coli
tattggcgcgctggactggacgccc

SEQ ID NO: 216864 - DNA, 25 bp, E. coli
tatctttcttatggttgccattggc

SEQ ID NO: 216865 - DNA, 25 bp, E. coli
tgaatccggtatcgactcggtcggc

SEQ ID NO: 216866 - DNA, 25 bp, E. coli
tgaatccggtatggactcggtcggc

SEQ ID NO: 216867 - DNA, 25 bp, E. coli
tctggtttatctggtgcgtattggc

SEQ ID NO: 216868 - DNA, 25 bp, E. coli
tctggtttatctcgtgcgtattggc

SEQ ID NO: 216869 - DNA, 25 bp, E. coli
gcttacgcctgtgcgccaagtttta

SEQ ID NO: 216870 - DNA, 25 bp, E. coli
gcttacgcctgtccgccaagtttta

SEQ ID NO: 216871 - DNA, 25 bp, E. coli
gctgtatctgttggcatggtcaacc

SEQ ID NO: 216872 - DNA, 25 bp, E. coli
gctgtatctgttcgcatggtcaacc

SEQ ID NO: 216873 - DNA, 25 bp, E. coli
gaagtcatcgctcatcactgggcat

SEQ ID NO: 216874 - DNA, 25 bp, E. coli
gaagtcatcgctgatcactgggcat

SEQ ID NO: 216875 - DNA, 25 bp, E. coli
gaacagtatcgcaaatcgtcaacgc

SEQ ID NO: 216876 - DNA, 25 bp, E. coli
gaacagtatcgctaatcgtcaacgc

SEQ ID NO: 216877 - DNA, 25 bp, E. coli
cgttatcttcgaggttgaagcgctg

SEQ ID NO: 216878 - DNA, 25 bp, E. coli
cgttatcttcgacgttgaagcgctg

SEQ ID NO: 216879 - DNA, 25 bp, E. coli
ggtcaacctctatccgcgaaagcgg

SEQ ID NO: 216880 - DNA, 25 bp, E. coli
ggtcaacctctaaccgcgaaagcgg

SEQ ID NO: 216881 - DNA, 25 bp, E. coli
caacatcgtgcgctagcctatcagg

SEQ ID NO: 216882 - DNA, 25 bp, E. coli
caacatcgtgcggtagcctatcagg

SEQ ID NO: 216883 - DNA, 25 bp, E. coli
aaaaacgctgcgaaccgatctgctg

SEQ ID NO: 216884 - DNA, 25 bp, E. coli
aaaaacgctgcgtaccgatctgctg

SEQ ID NO: 216885 - DNA, 25 bp, E. coli
tacgcccggctgctgattgatgaca

SEQ ID NO: 216886 - DNA, 25 bp, E. coli
tacgcccggctggtgattgatgaca

SEQ ID NO: 216887 - DNA, 25 bp, E. coli
tatcgtgataaaggcactcagggcg

SEQ ID NO: 216888 - DNA, 25 bp, E. coli
tatcaggttgagcactacgccaccg

SEQ ID NO: 216889 - DNA, 25 bp, E. coli
tatcgtgataaacgcactcagggcg

SEQ ID NO: 216890 - DNA, 25 bp, E. coli
tatcaggttgaggactacgccaccg

SEQ ID NO: 216891 - DNA, 25 bp, E. coli
ttatcgaaacccttaccgctggcgg

SEQ ID NO: 216892 - DNA, 25 bp, E. coli
ttaatggcggcatatacagcgacga

SEQ ID NO: 216893 - DNA, 25 bp, E. coli
ttatcgaaacccataccgctggcgg

SEQ ID NO: 216894 - DNA, 25 bp, E. coli
ttaatggcggcaaatacagcgacga

SEQ ID NO: 216895 - DNA, 25 bp, E. coli
tgcatcgccggaaggaaaaacgctg

SEQ ID NO: 216896 - DNA, 25 bp, E. coli
tgaaaaatccgatgtccggcaccgg

SEQ ID NO: 216897 - DNA, 25 bp, E. coli
tgcatcgccggatggaaaaacgctg

SEQ ID NO: 216898 - DNA, 25 bp, E. coli
tgaaaaatccgaagtccggcaccgg

SEQ ID NO: 216899 - DNA, 25 bp, E. coli
tcatatattactaacgcgaccgcgc

SEQ ID NO: 216900 - DNA, 25 bp, E. coli
tcatatattacttacgcgaccgcgc

SEQ ID NO: 216901 - DNA, 25 bp, E. coli
gaatatatacaccagcaggtgccgg

SEQ ID NO: 216902 - DNA, 25 bp, E. coli
gaatatatacacgagcaggtgccgg

SEQ ID NO: 216903 - DNA, 25 bp, E. coli
agtaagaatgataggctatattggg

SEQ ID NO: 216904 - DNA, 25 bp, E. coli
atgtctcatcaggttccttgtgtga

SEQ ID NO: 216905 - DNA, 25 bp, E. coli
atgtctcatcagcttccttgtgtga

SEQ ID NO: 216906 - DNA, 25 bp, E. coli
agtaagaatgattggctatattggg

SEQ ID NO: 216907 - DNA, 25 bp, E. coli
aacggaaactgccagtgctgtatga

SEQ ID NO: 216908 - DNA, 25 bp, E. coli
aacggaaactgcgagtgctgtatga

SEQ ID NO: 216909 - DNA, 25 bp, E. coli
tcatcagcttccttgtgtgacaaat

SEQ ID NO: 216910 - DNA, 25 bp, E. coli
tcatcagcttccatgtgtgacaaat

SEQ ID NO: 216911 - DNA, 25 bp, E. coli
ccttgtgtgacatatttcttaagca

SEQ ID NO: 216912 - DNA, 25 bp, E. coli
ccttgtgtgacaaatttcttaagca

SEQ ID NO: 216913 - DNA, 25 bp, E. coli
ggaagagactctggcaacggaaact

SEQ ID NO: 216914 - DNA, 25 bp, E. coli
ggaagagactctcgcaacggaaact

SEQ ID NO: 216915 - DNA, 25 bp, E. coli
tggcaacggaaagtgccagtgctgt

SEQ ID NO: 216916 - DNA, 25 bp, E. coli
tggcaacggaaactgccagtgctgt

SEQ ID NO: 216917 - DNA, 25 bp, E. coli
taagcattatctctgatgaggcggg

SEQ ID NO: 216918 - DNA, 25 bp, E. coli
tcaaagggagtaagaatgattggct

SEQ ID NO: 216919 - DNA, 25 bp, E. coli
taagcattatctgtgatgaggcggg

SEQ ID NO: 216920 - DNA, 25 bp, E. coli
tcaaagggagtatgaatgattggct

SEQ ID NO: 216921 - DNA, 25 bp, E. coli
gatgaggcgggtaattcaaagggag

SEQ ID NO: 216922 - DNA, 25 bp, E. coli
gatgaggcgggttattcaaagggag

SEQ ID NO: 216923 - DNA, 25 bp, E. coli
gagactctggcatcggaaactgcca

SEQ ID NO: 216924 - DNA, 25 bp, E. coli
gagactctggcaacggaaactgcca

SEQ ID NO: 216925 - DNA, 25 bp, E. coli
caatgtgtgtggaatctaacggccc

SEQ ID NO: 216926 - DNA, 25 bp, E. coli
aagtcgctcggctgttcgattcaga

SEQ ID NO: 216927 - DNA, 25 bp, E. coli
aagtcgctcggcagttcgattcaga

SEQ ID NO: 216928 - DNA, 25 bp, E. coli
caatgtgtgtggtatctaacggccc

SEQ ID NO: 216929 - DNA, 25 bp, E. coli
cagacccggcgtaaatgttccatgc

SEQ ID NO: 216930 - DNA, 25 bp, E. coli
cagacccggcgttaatgttccatgc

SEQ ID NO: 216931 - DNA, 25 bp, E. coli
acgtttaccgtggagaagtcgctcg

SEQ ID NO: 216932 - DNA, 25 bp, E. coli
acgtttaccgtgcagaagtcgctcg

SEQ ID NO: 216933 - DNA, 25 bp, E. coli
aaaatgcagcattctatgggcaagc

SEQ ID NO: 216934 - DNA, 25 bp, E. coli
aaaatgcagcatactatgggcaagc

SEQ ID NO: 216935 - DNA, 25 bp, E. coli
tatcgacgcaggtatggaagtgttc

SEQ ID NO: 216936 - DNA, 25 bp, E. coli
tatcgacgcaggaatggaagtgttc

SEQ ID NO: 216937 - DNA, 25 bp, E. coli
tgtcagcgatcactgcgccaatgtg

SEQ ID NO: 216938 - DNA, 25 bp, E. coli
tgtcagcgatcagtgcgccaatgtg

SEQ ID NO: 216939 - DNA, 25 bp, E. coli
tgccggtgcacaatctggtatcgac

SEQ ID NO: 216940 - DNA, 25 bp, E. coli
tgccggtgcacattctggtatcgac

SEQ ID NO: 216941 - DNA, 25 bp, E. coli
cgatattcagcggtggaagccagac

SEQ ID NO: 216942 - DNA, 25 bp, E. coli
cgatattcagcgctggaagccagac

SEQ ID NO: 216943 - DNA, 25 bp, E. coli
gttacctgaactgtggaaagcgcgt

SEQ ID NO: 216944 - DNA, 25 bp, E. coli
gttacctgaactctggaaagcgcgt

SEQ ID NO: 216945 - DNA, 25 bp, E. coli
ggttgatgactctgttgccggtgca

SEQ ID NO: 216946 - DNA, 25 bp, E. coli
ggttgatgactcagttgccggtgca

SEQ ID NO: 216947 - DNA, 25 bp, E. coli
aatcatgctggtcaaaattcaggcc

SEQ ID NO: 216948 - DNA, 25 bp, E. coli
aatcatgctggtgaaaattcaggcc

SEQ ID NO: 216949 - DNA, 25 bp, E. coli
acattgaaagccagaccgttgcgcc

SEQ ID NO: 216950 - DNA, 25 bp, E. coli
aaattcaggccagcggttacgggcg

SEQ ID NO: 216951 - DNA, 25 bp, E. coli
acattgaaagcctgaccgttgcgcc

SEQ ID NO: 216952 - DNA, 25 bp, E. coli
aaattcaggccaccggttacgggcg

SEQ ID NO: 216953 - DNA, 25 bp, E. coli
taccgttcaatttgcaggcaccagc

SEQ ID NO: 216954 - DNA, 25 bp, E. coli
taccgttcaattagcaggcaccagc

SEQ ID NO: 216955 - DNA, 25 bp, E. coli
tgattggccttttttcccagcgtgg

SEQ ID NO: 216956 - DNA, 25 bp, E. coli
tgattggcctttattcccagcgtgg

SEQ ID NO: 216957 - DNA, 25 bp, E. coli
tgctcgctctggtgtggtcggactt

SEQ ID NO: 216958 - DNA, 25 bp, E. coli
tgctcgctctggagtggtcggactt

SEQ ID NO: 216959 - DNA, 25 bp, E. coli
tcttactcgaaaatgaatcaggcgc

SEQ ID NO: 216960 - DNA, 25 bp, E. coli
tcttactcgaaattgaatcaggcgc

SEQ ID NO: 216961 - DNA, 25 bp, E. coli
gcatcgattcgcgatgtggcgaaaa

SEQ ID NO: 216962 - DNA, 25 bp, E. coli
gcatcgattcgccatgtggcgaaaa

SEQ ID NO: 216963 - DNA, 25 bp, E. coli
gaatcaggcgcgttatcccgcgtga

SEQ ID NO: 216964 - DNA, 25 bp, E. coli
gaatcaggcgcgatatcccgcgtga

SEQ ID NO: 216965 - DNA, 25 bp, E. coli
gatccgacattaacgcgtatgacca

SEQ ID NO: 216966 - DNA, 25 bp, E. coli
gatgtcacaccctcgctttataccg

SEQ ID NO: 216967 - DNA, 25 bp, E. coli
gatgtcacacccacgctttataccg

SEQ ID NO: 216968 - DNA, 25 bp, E. coli
gatccgacattatcgcgtatgacca

SEQ ID NO: 216969 - DNA, 25 bp, E. coli
aataccatgttttccgtgctagtga

SEQ ID NO: 216970 - DNA, 25 bp, E. coli
aataccatgtttaccgtgctagtga

SEQ ID NO: 216971 - DNA, 25 bp, E. coli
catgatttcggtgtatcgtgacggg

SEQ ID NO: 216972 - DNA, 25 bp, E. coli
catgatttcggtctatcgtgacggg

SEQ ID NO: 216973 - DNA, 25 bp, E. coli
taaatgatgaattaacgcccctgtt

SEQ ID NO: 216974 - DNA, 25 bp, E. coli
taaatgatgaataaacgcccctgtt

SEQ ID NO: 216975 - DNA, 25 bp, E. coli
aaatctacgtatcgcgtggacagac

SEQ ID NO: 216976 - DNA, 25 bp, E. coli
aaatctacgtatggcgtggacagac

SEQ ID NO: 216977 - DNA, 25 bp, E. coli
ttctcaccgtagtcccaggcattgc

SEQ ID NO: 216978 - DNA, 25 bp, E. coli
ttctcaccgtagacccaggcattgc

SEQ ID NO: 216979 - DNA, 25 bp, E. coli
tgatgtcgataggtgccacaaggca

SEQ ID NO: 216980 - DNA, 25 bp, E. coli
tgatgtcgatagctgccacaaggca

SEQ ID NO: 216981 - DNA, 25 bp, E. coli
tcgtgacgggtagcgactctgaaca

SEQ ID NO: 216982 - DNA, 25 bp, E. coli
tcgtgacgggtaccgactctgaaca

SEQ ID NO: 216983 - DNA, 25 bp, E. coli
gacagacgccatacgtgatgtcgat

SEQ ID NO: 216984 - DNA, 25 bp, E. coli
gacaatcccctgctgttttgcgaaa

SEQ ID NO: 216985 - DNA, 25 bp, E. coli
gacagacgccattcgtgatgtcgat

SEQ ID NO: 216986 - DNA, 25 bp, E. coli
gacaatcccctggtgttttgcgaaa

SEQ ID NO: 216987 - DNA, 25 bp, E. coli
cattgcgcgccgagaatcttcatga

SEQ ID NO: 216988 - DNA, 25 bp, E. coli
cattgcgcgccgtgaatcttcatga

SEQ ID NO: 216989 - DNA, 25 bp, E. coli
gataagcaggtcaaattctcccgtc

SEQ ID NO: 216990 - DNA, 25 bp, E. coli
gataagcaggtctaattctcccgtc

SEQ ID NO: 216991 - DNA, 25 bp, E. coli
atcgtcaggtgtggatccgcgcaaa

SEQ ID NO: 216992 - DNA, 25 bp, E. coli
atcaaaaaacaatgccgtccgcgcc

SEQ ID NO: 216993 - DNA, 25 bp, E. coli
atcgtcaggtgtcgatccgcgcaaa

SEQ ID NO: 216994 - DNA, 25 bp, E. coli
atcaaaaaacaaagccgtccgcgcc

SEQ ID NO: 216995 - DNA, 25 bp, E. coli
acagctactttcttcgccctggcga

SEQ ID NO: 216996 - DNA, 25 bp, E. coli
acagctactttcatcgccctggcga

SEQ ID NO: 216997 - DNA, 25 bp, E. coli
ttgaggaaggactctttcgcggcca

SEQ ID NO: 216998 - DNA, 25 bp, E. coli
ttgaggaaggacactttcgcggcca

SEQ ID NO: 216999 - DNA, 25 bp, E. coli
tgtatgctgcaaaagagaccgtccc

SEQ ID NO: 217000 - DNA, 25 bp, E. coli
tgtatgctgcaatagagaccgtccc

SEQ ID NO: 217001 - DNA, 25 bp, E. coli
tcgcggccagagtgaagatttaggt

SEQ ID NO: 217002 - DNA, 25 bp, E. coli
tcgaaacgctgcctgacggtaacag

SEQ ID NO: 217003 - DNA, 25 bp, E. coli
tcgaaacgctgcgtgacggtaacag

SEQ ID NO: 217004 - DNA, 25 bp, E. coli
tcgcggccagagagaagatttaggt

SEQ ID NO: 217005 - DNA, 25 bp, E. coli
tgcgcgttcatctgtatctgctcgg

SEQ ID NO: 217006 - DNA, 25 bp, E. coli
tgcgcgttcatcagtatctgctcgg

SEQ ID NO: 217007 - DNA, 25 bp, E. coli
tctttccaggcagcagaagcgggtt

SEQ ID NO: 217008 - DNA, 25 bp, E. coli
tctttccaggcaccagaagcgggtt

SEQ ID NO: 217009 - DNA, 25 bp, E. coli
gccctggcgatactaagaagccgat

SEQ ID NO: 217010 - DNA, 25 bp, E. coli
gccctggcgatagtaagaagccgat

SEQ ID NO: 217011 - DNA, 25 bp, E. coli
ccgcgcaaatggaagcgtgccggat

SEQ ID NO: 217012 - DNA, 25 bp, E. coli
ccgcgcaaatggtagcgtgccggat

SEQ ID NO: 217013 - DNA, 25 bp, E. coli
catggtgatgcctaatatcggcgcg

SEQ ID NO: 217014 - DNA, 25 bp, E. coli
catggtgatgccaaatatcggcgcg

SEQ ID NO: 217015 - DNA, 25 bp, E. coli
tgttctgccagtacccggaaggcgt

SEQ ID NO: 217016 - DNA, 25 bp, E. coli
tgttcacgctgactatcctgggcgg

SEQ ID NO: 217017 - DNA, 25 bp, E. coli
tgattgaagctatcccaggtccagg

SEQ ID NO: 217018 - DNA, 25 bp, E. coli
tgttcacgctgagtatcctgggcgg

SEQ ID NO: 217019 - DNA, 25 bp, E. coli
tgattgaagctaacccaggtccagg

SEQ ID NO: 217020 - DNA, 25 bp, E. coli
tgttctgccagttcccggaaggcgt

SEQ ID NO: 217021 - DNA, 25 bp, E. coli
tgcattaagcacatcgaccgctggg

SEQ ID NO: 217022 - DNA, 25 bp, E. coli
tgagtccgtcatcgagcgtctggca

SEQ ID NO: 217023 - DNA, 25 bp, E. coli
tgcattaagcacttcgaccgctggg

SEQ ID NO: 217024 - DNA, 25 bp, E. coli
tgagtccgtcatggagcgtctggca

SEQ ID NO: 217025 - DNA, 25 bp, E. coli
ccacacggtacgcttgaagcgaaag

SEQ ID NO: 217026 - DNA, 25 bp, E. coli
ccacacggtacggttgaagcgaaag

SEQ ID NO: 217027 - DNA, 25 bp, E. coli
gcgatgtgactaacgacctgagcca

SEQ ID NO: 217028 - DNA, 25 bp, E. coli
gcgatgtgactatcgacctgagcca

SEQ ID NO: 217029 - DNA, 25 bp, E. coli
gaagcgattcgtattgctggcgagc

SEQ ID NO: 217030 - DNA, 25 bp, E. coli
gaagcgattcgttttgctggcgagc

SEQ ID NO: 217031 - DNA, 25 bp, E. coli
ggatcgtgaaaaactgaccccgact

SEQ ID NO: 217032 - DNA, 25 bp, E. coli
ggatcgtgaaaatctgaccccgact

SEQ ID NO: 217033 - DNA, 25 bp, E. coli
gagaacatcttcctcggtcgcaaag

SEQ ID NO: 217034 - DNA, 25 bp, E. coli
gagaacatcttcgtcggtcgcaaag

SEQ ID NO: 217035 - DNA, 25 bp, E. coli
caagcgatgctccacgccgggctga

SEQ ID NO: 217036 - DNA, 25 bp, E. coli
caagcgatgctcgacgccgggctga

SEQ ID NO: 217037 - DNA, 25 bp, E. coli
cgttttcgttcgattgaacaagcga

SEQ ID NO: 217038 - DNA, 25 bp, E. coli
cgttttcgttcgtttgaacaagcga

SEQ ID NO: 217039 - DNA, 25 bp, E. coli
tttcgttcgattgaacaagcgatgc

SEQ ID NO: 217040 - DNA, 25 bp, E. coli
ttcgattgaacaagcgatgctcgac

SEQ ID NO: 217041 - DNA, 25 bp, E. coli
ttcgattgaacatgcgatgctcgac

SEQ ID NO: 217042 - DNA, 25 bp, E. coli
tttcgttcgattcaacaagcgatgc

SEQ ID NO: 217043 - DNA, 25 bp, E. coli
tcgattgaacaaccgatgctcgacg

SEQ ID NO: 217044 - DNA, 25 bp, E. coli
tcgattgaacaagcgatgctcgacg

SEQ ID NO: 217045 - DNA, 25 bp, E. coli
gctgagtgccgatgaagccagtgca

SEQ ID NO: 217046 - DNA, 25 bp, E. coli
gcgctggcgttttcgttcgattgaa

SEQ ID NO: 217047 - DNA, 25 bp, E. coli
gctgagtgccgaagaagccagtgca

SEQ ID NO: 217048 - DNA, 25 bp, E. coli
gctggcgttttcgttcgattgaaca

SEQ ID NO: 217049 - DNA, 25 bp, E. coli
gctggcgttttccttcgattgaaca

SEQ ID NO: 217050 - DNA, 25 bp, E. coli
gcgctggcgtttacgttcgattgaa

SEQ ID NO: 217051 - DNA, 25 bp, E. coli
cgttcgattgaagaagcgatgctcg

SEQ ID NO: 217052 - DNA, 25 bp, E. coli
cgttcgattgaacaagcgatgctcg

SEQ ID NO: 217053 - DNA, 25 bp, E. coli
gattgaacaagcgatgctcgacgcc

SEQ ID NO: 217054 - DNA, 25 bp, E. coli
gattgaacaagccatgctcgacgcc

SEQ ID NO: 217055 - DNA, 25 bp, E. coli
tggcgttttcgttcgattgaacaag

SEQ ID NO: 217056 - DNA, 25 bp, E. coli
tggcgttttcgtacgattgaacaag

SEQ ID NO: 217057 - DNA, 25 bp, E. coli
caaatgctggaacgcgatatctaca

SEQ ID NO: 217058 - DNA, 25 bp, E. coli
caaatgctggaaggcgatatctaca

SEQ ID NO: 217059 - DNA, 25 bp, E. coli
catcgtggttatgggtctgctgcgc

SEQ ID NO: 217060 - DNA, 25 bp, E. coli
catcgtggttatcggtctgctgcgc

SEQ ID NO: 217061 - DNA, 25 bp, E. coli
tgtggtaagcaagaccctgacggca

SEQ ID NO: 217062 - DNA, 25 bp, E. coli
tgtggtaagcaacaccctgacggca

SEQ ID NO: 217063 - DNA, 25 bp, E. coli
tgaaattgatgctctgtcggcgcgt

SEQ ID NO: 217064 - DNA, 25 bp, E. coli
tgaaattgatgcactgtcggcgcgt

SEQ ID NO: 217065 - DNA, 25 bp, E. coli
tgctcaagtacagcatcatgcgcgg

SEQ ID NO: 217066 - DNA, 25 bp, E. coli
tgctcaagtacaccatcatgcgcgg

SEQ ID NO: 217067 - DNA, 25 bp, E. coli
gctgaaacaacgacgctggctgggc

SEQ ID NO: 217068 - DNA, 25 bp, E. coli
gctgaaacaacgtcgctggctgggc

SEQ ID NO: 217069 - DNA, 25 bp, E. coli
gaaagacaccttcagccttagcgta

SEQ ID NO: 217070 - DNA, 25 bp, E. coli
gaaagacaccttgagccttagcgta

SEQ ID NO: 217071 - DNA, 25 bp, E. coli
cttcttcgggcacaacggtgcgctg

SEQ ID NO: 217072 - DNA, 25 bp, E. coli
cttcttcgggcagaacggtgcgctg

SEQ ID NO: 217073 - DNA, 25 bp, E. coli
gataacatcaacgactcggcgctgg

SEQ ID NO: 217074 - DNA, 25 bp, E. coli
gataacatcaaccactcggcgctgg

SEQ ID NO: 217075 - DNA, 25 bp, E. coli
gtaatgagatggtcgatccggcgct

SEQ ID NO: 217076 - DNA, 25 bp, E. coli
gtaatgagatggacgatccggcgct

SEQ ID NO: 217077 - DNA, 25 bp, E. coli
gatgcgtctaaccttgagcgtaacc

SEQ ID NO: 217078 - DNA, 25 bp, E. coli
gatgcgtctaacgttgagcgtaacc

SEQ ID NO: 217079 - DNA, 25 bp, E. coli
aaagagctgggctatccttacgcgc

SEQ ID NO: 217080 - DNA, 25 bp, E. coli
aaagagctgggcaatccttacgcgc

SEQ ID NO: 217081 - DNA, 25 bp, E. coli
tattgacggcaacggcatcattcgc

SEQ ID NO: 217082 - DNA, 25 bp, E. coli
tattgacggcaagggcatcattcgc

SEQ ID NO: 217083 - DNA, 25 bp, E. coli
tgcttaacgtctgggcgacctggtg

SEQ ID NO: 217084 - DNA, 25 bp, E. coli
tgcttaacgtctcggcgacctggtg

SEQ ID NO: 217085 - DNA, 25 bp, E. coli
tgccgtgcggaacatcaatatctga

SEQ ID NO: 217086 - DNA, 25 bp, E. coli
tgccgtgcggaagatcaatatctga

SEQ ID NO: 217087 - DNA, 25 bp, E. coli
cctcgcgtctgggaagaagagatca

SEQ ID NO: 217088 - DNA, 25 bp, E. coli
cctcgcgtctggcaagaagagatca

SEQ ID NO: 217089 - DNA, 25 bp, E. coli
gaaatacagtaaggaggccgcacaa

SEQ ID NO: 217090 - DNA, 25 bp, E. coli
gaaatacagtaacgaggccgcacaa

SEQ ID NO: 217091 - DNA, 25 bp, E. coli
ccgcgtggtcgggatgaactataaa

SEQ ID NO: 217092 - DNA, 25 bp, E. coli
ccgcgtggtcggcatgaactataaa

SEQ ID NO: 217093 - DNA, 25 bp, E. coli
gattatcttcctggcgattgccgcg

SEQ ID NO: 217094 - DNA, 25 bp, E. coli
gattatcttcctcgcgattgccgcg

SEQ ID NO: 217095 - DNA, 25 bp, E. coli
tggatctcggtgactatggcgcgcc

SEQ ID NO: 217096 - DNA, 25 bp, E. coli
tggatctcggtgtctatggcgcgcc

SEQ ID NO: 217097 - DNA, 25 bp, E. coli
gatgtgctgactcagggcaaaccag

SEQ ID NO: 217098 - DNA, 25 bp, E. coli
gaccaatctggattcggcgctcatt

SEQ ID NO: 217099 - DNA, 25 bp, E. coli
gatgtgctgactgagggcaaaccag

SEQ ID NO: 217100 - DNA, 25 bp, E. coli
gaccaatctggaatcggcgctcatt

SEQ ID NO: 217101 - DNA, 25 bp, E. coli
caggcgatctcgattttgtctcttc

SEQ ID NO: 217102 - DNA, 25 bp, E. coli
caggcgatctcgtttttgtctcttc

SEQ ID NO: 217103 - DNA, 25 bp, E. coli
ttgatgtgcccgttccaggcgatct

SEQ ID NO: 217104 - DNA, 25 bp, E. coli
ttgatgtgcccgatccaggcgatct

SEQ ID NO: 217105 - DNA, 25 bp, E. coli
ttccaggcgatctcgtttttgtctc

SEQ ID NO: 217106 - DNA, 25 bp, E. coli
ttccaggcgatcacgtttttgtctc

SEQ ID NO: 217107 - DNA, 25 bp, E. coli
tgtgcccgttcctggcgatctcgtt

SEQ ID NO: 217108 - DNA, 25 bp, E. coli
tgtgcccgttccaggcgatctcgtt

SEQ ID NO: 217109 - DNA, 25 bp, E. coli
tgatgtgcccgtaccaggcgatctc

SEQ ID NO: 217110 - DNA, 25 bp, E. coli
tgatgtgcccgttccaggcgatctc

SEQ ID NO: 217111 - DNA, 25 bp, E. coli
tccaggcgatctcgtttttgtctct

SEQ ID NO: 217112 - DNA, 25 bp, E. coli
tccaggcgatctggtttttgtctct

SEQ ID NO: 217113 - DNA, 25 bp, E. coli
cgttccaggcgatctcgtttttgtc

SEQ ID NO: 217114 - DNA, 25 bp, E. coli
cccgttccaggccatctcgtttttg

SEQ ID NO: 217115 - DNA, 25 bp, E. coli
cccgttccaggcgatctcgtttttg

SEQ ID NO: 217116 - DNA, 25 bp, E. coli
cgttccaggcgaactcgtttttgtc

SEQ ID NO: 217117 - DNA, 25 bp, E. coli
ggcgatctcgttattgtctcttcat

SEQ ID NO: 217118 - DNA, 25 bp, E. coli
ggcgatctcgtttttgtctcttcat

SEQ ID NO: 217119 - DNA, 25 bp, E. coli
gatgtgcccgttgcaggcgatctcg

SEQ ID NO: 217120 - DNA, 25 bp, E. coli
gtgcccgttccacgcgatctcgttt

SEQ ID NO: 217121 - DNA, 25 bp, E. coli
gtgcccgttccaggcgatctcgttt

SEQ ID NO: 217122 - DNA, 25 bp, E. coli
gatgtgcccgttccaggcgatctcg

SEQ ID NO: 217123 - DNA, 25 bp, E. coli
cacgcgatgttgtcattgctcaaag

SEQ ID NO: 217124 - DNA, 25 bp, E. coli
cacgcgatgttgacattgctcaaag

SEQ ID NO: 217125 - DNA, 25 bp, E. coli
tatagaaagccaagaacacgcgatg

SEQ ID NO: 217126 - DNA, 25 bp, E. coli
tatagaaagccatgaacacgcgatg

SEQ ID NO: 217127 - DNA, 25 bp, E. coli
tgatctcaccaaccagcaactcgat

SEQ ID NO: 217128 - DNA, 25 bp, E. coli
tgatctcaccaagcagcaactcgat

SEQ ID NO: 217129 - DNA, 25 bp, E. coli
tgctcaaagagcttcgagatatgac

SEQ ID NO: 217130 - DNA, 25 bp, E. coli
tgctcaaagagcatcgagatatgac

SEQ ID NO: 217131 - DNA, 25 bp, E. coli
tccggatgggcaaggcatcaacaat

SEQ ID NO: 217132 - DNA, 25 bp, E. coli
tccggatgggcatggcatcaacaat

SEQ ID NO: 217133 - DNA, 25 bp, E. coli
tcgaaacagaacgagcagagagccc

SEQ ID NO: 217134 - DNA, 25 bp, E. coli
tcgaaacagaaccagcagagagccc

SEQ ID NO: 217135 - DNA, 25 bp, E. coli
ccatcatgatgagctataaggagtg

SEQ ID NO: 217136 - DNA, 25 bp, E. coli
ccatcatgatgacctataaggagtg

SEQ ID NO: 217137 - DNA, 25 bp, E. coli
gatacttagtaattattcgccagca

SEQ ID NO: 217138 - DNA, 25 bp, E. coli
gatacttagtaaatattcgccagca

SEQ ID NO: 217139 - DNA, 25 bp, E. coli
gagatatgacccaaccaaccaggaa

SEQ ID NO: 217140 - DNA, 25 bp, E. coli
gatgtccatcgtatcggtaacctct

SEQ ID NO: 217141 - DNA, 25 bp, E. coli
gatgtccatcgtttcggtaacctct

SEQ ID NO: 217142 - DNA, 25 bp, E. coli
gagagcccaaaacaagccatcatga

SEQ ID NO: 217143 - DNA, 25 bp, E. coli
gagagcccaaaagaagccatcatga

SEQ ID NO: 217144 - DNA, 25 bp, E. coli
gagatatgaccctaccaaccaggaa

SEQ ID NO: 217145 - DNA, 25 bp, E. coli
aaccactaacgccacgcctgagcag

SEQ ID NO: 217146 - DNA, 25 bp, E. coli
aaccactaacgcgacgcctgagcag

SEQ ID NO: 217147 - DNA, 25 bp, E. coli
cagcccgatggagcggatcattgaa

SEQ ID NO: 217148 - DNA, 25 bp, E. coli
cagcccgatggaccggatcattgaa

SEQ ID NO: 217149 - DNA, 25 bp, E. coli
actggcaatcccgaaacgtctgacg

SEQ ID NO: 217150 - DNA, 25 bp, E. coli
actggcaatccccaaacgtctgacg

SEQ ID NO: 217151 - DNA, 25 bp, E. coli
tgacgtaaccactaacgccacgcct

SEQ ID NO: 217152 - DNA, 25 bp, E. coli
tgacgtaaccacaaacgccacgcct

SEQ ID NO: 217153 - DNA, 25 bp, E. coli
tgacctgttggcgttgcgagctgaa

SEQ ID NO: 217154 - DNA, 25 bp, E. coli
tgacctgttggccttgcgagctgaa

SEQ ID NO: 217155 - DNA, 25 bp, E. coli
cgatggagcggaacattgaacaggt

SEQ ID NO: 217156 - DNA, 25 bp, E. coli
cgatggagcggatcattgaacaggt

SEQ ID NO: 217157 - DNA, 25 bp, E. coli
cccgatggagcgcatcattgaacag

SEQ ID NO: 217158 - DNA, 25 bp, E. coli
cgacagcccgatcgagcggatcatt

SEQ ID NO: 217159 - DNA, 25 bp, E. coli
cccgatggagcggatcattgaacag

SEQ ID NO: 217160 - DNA, 25 bp, E. coli
cgacagcccgatggagcggatcatt

SEQ ID NO: 217161 - DNA, 25 bp, E. coli
tggcaatcccgaaacgtctgacgac

SEQ ID NO: 217162 - DNA, 25 bp, E. coli
tggcaatcccgatacgtctgacgac

SEQ ID NO: 217163 - DNA, 25 bp, E. coli
tggagcggatcattgaacaggtgct

SEQ ID NO: 217164 - DNA, 25 bp, E. coli
tggagcggatcaatgaacaggtgct

SEQ ID NO: 217165 - DNA, 25 bp, E. coli
gagcggatcattgaacaggtgctga

SEQ ID NO: 217166 - DNA, 25 bp, E. coli
gagcggatcattcaacaggtgctga

SEQ ID NO: 217167 - DNA, 25 bp, E. coli
taaaatcgctgcaagctgtacaagg

SEQ ID NO: 217168 - DNA, 25 bp, E. coli
taaaatcgctgctagctgtacaagg

SEQ ID NO: 217169 - DNA, 25 bp, E. coli
tagggtacagtcgttggcaacatgg

SEQ ID NO: 217170 - DNA, 25 bp, E. coli
tatggatcttccgataccagacgct

SEQ ID NO: 217171 - DNA, 25 bp, E. coli
tagcgagcgaaaaattctgacagcc

SEQ ID NO: 217172 - DNA, 25 bp, E. coli
tagcgagcgaaatattctgacagcc

SEQ ID NO: 217173 - DNA, 25 bp, E. coli
tagggtacagtccttggcaacatgg

SEQ ID NO: 217174 - DNA, 25 bp, E. coli
tatggatcttcccataccagacgct

SEQ ID NO: 217175 - DNA, 25 bp, E. coli
tccagaattgatggtaaggccagct

SEQ ID NO: 217176 - DNA, 25 bp, E. coli
tccagaattgatcgtaaggccagct

SEQ ID NO: 217177 - DNA, 25 bp, E. coli
tcataacccgacaggaacagtctgg

SEQ ID NO: 217178 - DNA, 25 bp, E. coli
tctggtcggaagaagaactgcataa

SEQ ID NO: 217179 - DNA, 25 bp, E. coli
tctggtcggaagtagaactgcataa

SEQ ID NO: 217180 - DNA, 25 bp, E. coli
tcataacccgactggaacagtctgg

SEQ ID NO: 217181 - DNA, 25 bp, E. coli
cctggcctgcggacgagaaaaatta

SEQ ID NO: 217182 - DNA, 25 bp, E. coli
ccaatgggacttatgcgaggacaga

SEQ ID NO: 217183 - DNA, 25 bp, E. coli
ccaatgggacttttgcgaggacaga

SEQ ID NO: 217184 - DNA, 25 bp, E. coli
cctggcctgcggtcgagaaaaatta

SEQ ID NO: 217185 - DNA, 25 bp, E. coli
tggataacctattgccccagtgtga

SEQ ID NO: 217186 - DNA, 25 bp, E. coli
tggataacctatagccccagtgtga

SEQ ID NO: 217187 - DNA, 25 bp, E. coli
gagggctaccttcgtctgaacctgg

SEQ ID NO: 217188 - DNA, 25 bp, E. coli
gagggctaccttggtctgaacctgg

SEQ ID NO: 217189 - DNA, 25 bp, E. coli
cagatggtgaatgtgaggcttccta

SEQ ID NO: 217190 - DNA, 25 bp, E. coli
cagatggtgaatctgaggcttccta

SEQ ID NO: 217191 - DNA, 25 bp, E. coli
agatggtgaatgtgaggcttcctag

SEQ ID NO: 217192 - DNA, 25 bp, E. coli
agatggtgaatgagaggcttcctag

SEQ ID NO: 217193 - DNA, 25 bp, E. coli
attaacgccgcaaacctggtggcct

SEQ ID NO: 217194 - DNA, 25 bp, E. coli
acgccgcatacctggtggcctgtgc

SEQ ID NO: 217195 - DNA, 25 bp, E. coli
attaacgccgcatacctggtggcct

SEQ ID NO: 217196 - DNA, 25 bp, E. coli
acgccgcataccaggtggcctgtgc

SEQ ID NO: 217197 - DNA, 25 bp, E. coli
tgattaacgccggatacctggtggc

SEQ ID NO: 217198 - DNA, 25 bp, E. coli
tgattaacgccgcatacctggtggc

SEQ ID NO: 217199 - DNA, 25 bp, E. coli
tgtgcagatggtcaatgtgaggctt

SEQ ID NO: 217200 - DNA, 25 bp, E. coli
tgtgcagatggtgaatgtgaggctt

SEQ ID NO: 217201 - DNA, 25 bp, E. coli
gcagatggtgaaagtgaggcttcct

SEQ ID NO: 217202 - DNA, 25 bp, E. coli
gcagatggtgaatgtgaggcttcct

SEQ ID NO: 217203 - DNA, 25 bp, E. coli
ccgcatacctggtggcctgtgcaga

SEQ ID NO: 217204 - DNA, 25 bp, E. coli
ccgcatacctggaggcctgtgcaga

SEQ ID NO: 217205 - DNA, 25 bp, E. coli
cgcatacctggtggcctgtgcagat

SEQ ID NO: 217206 - DNA, 25 bp, E. coli
cgcatacctggtcgcctgtgcagat

SEQ ID NO: 217207 - DNA, 25 bp, E. coli
ctgtgcagatggagaatgtgaggct

SEQ ID NO: 217208 - DNA, 25 bp, E. coli
ctgtgcagatggtgaatgtgaggct

SEQ ID NO: 217209 - DNA, 25 bp, E. coli
gtgcagatggtgtatgtgaggcttc

SEQ ID NO: 217210 - DNA, 25 bp, E. coli
gtgcagatggtgaatgtgaggcttc

SEQ ID NO: 217211 - DNA, 25 bp, E. coli
caataatctgcatagcgatggcctc

SEQ ID NO: 217212 - DNA, 25 bp, E. coli
aacctgaccattttgatcgtcggcg

SEQ ID NO: 217213 - DNA, 25 bp, E. coli
aaggcgtttgcgttcgcgtacctca

SEQ ID NO: 217214 - DNA, 25 bp, E. coli
caataatctgcaaagcgatggcctc

SEQ ID NO: 217215 - DNA, 25 bp, E. coli
aaggcgtttgcgatcgcgtacctca

SEQ ID NO: 217216 - DNA, 25 bp, E. coli
aacctgaccattatgatcgtcggcg

SEQ ID NO: 217217 - DNA, 25 bp, E. coli
taaacaggtgcttcaggtgttaccg

SEQ ID NO: 217218 - DNA, 25 bp, E. coli
taaacaggtgctacaggtgttaccg

SEQ ID NO: 217219 - DNA, 25 bp, E. coli
tatcattgatactacgccggcggaa

SEQ ID NO: 217220 - DNA, 25 bp, E. coli
tatcattgatacaacgccggcggaa

SEQ ID NO: 217221 - DNA, 25 bp, E. coli
tggttgccgcacagttctacaaaga

SEQ ID NO: 217222 - DNA, 25 bp, E. coli
tggtcgtggtacactcaccagcggt

SEQ ID NO: 217223 - DNA, 25 bp, E. coli
cctgccactgatacgcattggtgaa

SEQ ID NO: 217224 - DNA, 25 bp, E. coli
cctgccactgattcgcattggtgaa

SEQ ID NO: 217225 - DNA, 25 bp, E. coli
ccttattgggcctgactggcgttga

SEQ ID NO: 217226 - DNA, 25 bp, E. coli
ccttattgggccagactggcgttga

SEQ ID NO: 217227 - DNA, 25 bp, E. coli
gaaagttatgcgatgatgacgccac

SEQ ID NO: 217228 - DNA, 25 bp, E. coli
gaaagttatgcgttgatgacgccac

SEQ ID NO: 217229 - DNA, 25 bp, E. coli
cgcgattattgcctgctggatcaaa

SEQ ID NO: 217230 - DNA, 25 bp, E. coli
cgcgattattgcgtgctggatcaaa

SEQ ID NO: 217231 - DNA, 25 bp, E. coli
tggttgccgcactgttctacaaaga

SEQ ID NO: 217232 - DNA, 25 bp, E. coli
tggtcgtggtactctcaccagcggt

SEQ ID NO: 217233 - DNA, 25 bp, E. coli
caatggtaggtctgtctcttgtcgg

SEQ ID NO: 217234 - DNA, 25 bp, E. coli
caatggtaggtcagtctcttgtcgg

SEQ ID NO: 217235 - DNA, 25 bp, E. coli
cagggcgtacagtgtgcaatgaaca

SEQ ID NO: 217236 - DNA, 25 bp, E. coli
cagggcgtacagagtgcaatgaaca

SEQ ID NO: 217237 - DNA, 25 bp, E. coli
tgttaataacgagaccctgtcaggg

SEQ ID NO: 217238 - DNA, 25 bp, E. coli
tgttaataacgacaccctgtcaggg

SEQ ID NO: 217239 - DNA, 25 bp, E. coli
gccagcaatggctgtcaggtgaccg

SEQ ID NO: 217240 - DNA, 25 bp, E. coli
gccagcaatggcagtcaggtgaccg

SEQ ID NO: 217241 - DNA, 25 bp, E. coli
ccaacgtgtcgttctggccagcaat

SEQ ID NO: 217242 - DNA, 25 bp, E. coli
ccaacgtgtcgtactggccagcaat

SEQ ID NO: 217243 - DNA, 25 bp, E. coli
ccatcatggtggaacagaaacaagg

SEQ ID NO: 217244 - DNA, 25 bp, E. coli
ccatcatggtggtacagaaacaagg

SEQ ID NO: 217245 - DNA, 25 bp, E. coli
cgcttctgaagccaaacaagtacag

SEQ ID NO: 217246 - DNA, 25 bp, E. coli
cgcttctgaagcgaaacaagtacag

SEQ ID NO: 217247 - DNA, 25 bp, E. coli
gattcagggcggtgatgattccaac

SEQ ID NO: 217248 - DNA, 25 bp, E. coli
ggtgtcgagctggaaattcgtaaag

SEQ ID NO: 217249 - DNA, 25 bp, E. coli
ggtgtcgagctgcaaattcgtaaag

SEQ ID NO: 217250 - DNA, 25 bp, E. coli
gattcagggcggagatgattccaac

SEQ ID NO: 217251 - DNA, 25 bp, E. coli
gggatgtttatagcgcttctgaagc

SEQ ID NO: 217252 - DNA, 25 bp, E. coli
gggatgtttataccgcttctgaagc

SEQ ID NO: 217253 - DNA, 25 bp, E. coli
ggaaccgggcgtactctggctactg

SEQ ID NO: 217254 - DNA, 25 bp, E. coli
ggaaccgggcgttctctggctactg

SEQ ID NO: 217255 - DNA, 25 bp, E. coli
tttggtgcttcggtaccgaaccatg

SEQ ID NO: 217256 - DNA, 25 bp, E. coli
tttggtgcttcgctaccgaaccatg

SEQ ID NO: 217257 - DNA, 25 bp, E. coli
ttcggtaccgaaccatgccgccatt

SEQ ID NO: 217258 - DNA, 25 bp, E. coli
ttcggtaccgaagcatgccgccatt

SEQ ID NO: 217259 - DNA, 25 bp, E. coli
tgtgctgctttgctgcttcggtacc

SEQ ID NO: 217260 - DNA, 25 bp, E. coli
tgtgctgctttggtgcttcggtacc

SEQ ID NO: 217261 - DNA, 25 bp, E. coli
tgctttggtgcttcggtaccgaacc

SEQ ID NO: 217262 - DNA, 25 bp, E. coli
tgctgctttggtgcttcggtaccga

SEQ ID NO: 217263 - DNA, 25 bp, E. coli
tgctgctttggtccttcggtaccga

SEQ ID NO: 217264 - DNA, 25 bp, E. coli
tgctttggtgctacggtaccgaacc

SEQ ID NO: 217265 - DNA, 25 bp, E. coli
ttggtgcttcggaaccgaaccatgc

SEQ ID NO: 217266 - DNA, 25 bp, E. coli
ttggtgcttcggtaccgaaccatgc

SEQ ID NO: 217267 - DNA, 25 bp, E. coli
gctgctttggtgcttcggtaccgaa

SEQ ID NO: 217268 - DNA, 25 bp, E. coli
gctttggtgcttgggtaccgaacca

SEQ ID NO: 217269 - DNA, 25 bp, E. coli
gctttggtgcttcggtaccgaacca

SEQ ID NO: 217270 - DNA, 25 bp, E. coli
gctgctttggtggttcggtaccgaa

SEQ ID NO: 217271 - DNA, 25 bp, E. coli
ctgctttggtgcatcggtaccgaac

SEQ ID NO: 217272 - DNA, 25 bp, E. coli
ctgctttggtgcttcggtaccgaac

SEQ ID NO: 217273 - DNA, 25 bp, E. coli
ctgtgctgctttggtgcttcggtac

SEQ ID NO: 217274 - DNA, 25 bp, E. coli
ctgtgctgctttcgtgcttcggtac

SEQ ID NO: 217275 - DNA, 25 bp, E. coli
ggtgcttcggtagcgaaccatgccg

SEQ ID NO: 217276 - DNA, 25 bp, E. coli
ggtgcttcggtaccgaaccatgccg

SEQ ID NO: 217277 - DNA, 25 bp, E. coli
tagtgccactggaagctcacgttcc

SEQ ID NO: 217278 - DNA, 25 bp, E. coli
tagtggcgtaatggcgacaggttcc

SEQ ID NO: 217279 - DNA, 25 bp, E. coli
tagtgccactggtagctcacgttcc

SEQ ID NO: 217280 - DNA, 25 bp, E. coli
tagtggcgtaatcgcgacaggttcc

SEQ ID NO: 217281 - DNA, 25 bp, E. coli
tattcgctaatgaagacaacgccgg

SEQ ID NO: 217282 - DNA, 25 bp, E. coli
tatattttctatacaggacccggca

SEQ ID NO: 217283 - DNA, 25 bp, E. coli
tatattttctattcaggacccggca

SEQ ID NO: 217284 - DNA, 25 bp, E. coli
tattcgctaatgtagacaacgccgg

SEQ ID NO: 217285 - DNA, 25 bp, E. coli
gccaaagtggaatcagcaacaacgg

SEQ ID NO: 217286 - DNA, 25 bp, E. coli
gccaaagtggaaacagcaacaacgg

SEQ ID NO: 217287 - DNA, 25 bp, E. coli
gcaaaaaatcgatccagcgctgaat

SEQ ID NO: 217288 - DNA, 25 bp, E. coli
gaatgtcacctcaggcccactgata

SEQ ID NO: 217289 - DNA, 25 bp, E. coli
gaatgtcacctctggcccactgata

SEQ ID NO: 217290 - DNA, 25 bp, E. coli
gcaaaaaatcgaaccagcgctgaat

SEQ ID NO: 217291 - DNA, 25 bp, E. coli
gactgcacacttgagggcacaggga

SEQ ID NO: 217292 - DNA, 25 bp, E. coli
gactgcacacttcagggcacaggga

SEQ ID NO: 217293 - DNA, 25 bp, E. coli
gacaggttccagacaaatattcgct

SEQ ID NO: 217294 - DNA, 25 bp, E. coli
gacaggttccagtcaaatattcgct

SEQ ID NO: 217295 - DNA, 25 bp, E. coli
cgtttatccggtcatgtcatcagca

SEQ ID NO: 217296 - DNA, 25 bp, E. coli
cgtttatccggtgatgtcatcagca

SEQ ID NO: 217297 - DNA, 25 bp, E. coli
tcaccccggtggaaaagaattcact

SEQ ID NO: 217298 - DNA, 25 bp, E. coli
tcaccccggtggtaaagaattcact

SEQ ID NO: 217299 - DNA, 25 bp, E. coli
aagagaactattgattcaagcaagc

SEQ ID NO: 217300 - DNA, 25 bp, E. coli
aagagaactattcattcaagcaagc

SEQ ID NO: 217301 - DNA, 25 bp, E. coli
caacaagaggtgtggttctgtgcga

SEQ ID NO: 217302 - DNA, 25 bp, E. coli
caacaagaggtgaggttctgtgcga

SEQ ID NO: 217303 - DNA, 25 bp, E. coli
acttcgtcctgatattgactggtca

SEQ ID NO: 217304 - DNA, 25 bp, E. coli
acttcgtcctgaaattgactggtca

SEQ ID NO: 217305 - DNA, 25 bp, E. coli
tgttcgcagaatatgtcagtgaagc

SEQ ID NO: 217306 - DNA, 25 bp, E. coli
tgttcgcagaatttgtcagtgaagc

SEQ ID NO: 217307 - DNA, 25 bp, E. coli
tcagtgaagcaagtaaatgacagta

SEQ ID NO: 217308 - DNA, 25 bp, E. coli
tcagtgaagcaactaaatgacagta

SEQ ID NO: 217309 - DNA, 25 bp, E. coli
gccgagagatgtgcagcaattgaac

SEQ ID NO: 217310 - DNA, 25 bp, E. coli
gccgagagatgtccagcaattgaac

SEQ ID NO: 217311 - DNA, 25 bp, E. coli
gcaattgaacgtgcaacaagaggtg

SEQ ID NO: 217312 - DNA, 25 bp, E. coli
gcaattgaacgtccaacaagaggtg

SEQ ID NO: 217313 - DNA, 25 bp, E. coli
gactggtcatatatacgacgttcgg

SEQ ID NO: 217314 - DNA, 25 bp, E. coli
gactggtcatatttacgacgttcgg

SEQ ID NO: 217315 - DNA, 25 bp, E. coli
cgacgttcggcatgttgttcgcaga

SEQ ID NO: 217316 - DNA, 25 bp, E. coli
cgacgttcggcaagttgttcgcaga

SEQ ID NO: 217317 - DNA, 25 bp, E. coli
ggtacgtcaattccctgccgagaga

SEQ ID NO: 217318 - DNA, 25 bp, E. coli
ggttctgtgcgatgaacttcgtcct

SEQ ID NO: 217319 - DNA, 25 bp, E. coli
ggttctgtgcgaagaacttcgtcct

SEQ ID NO: 217320 - DNA, 25 bp, E. coli
ggtacgtcaattgcctgccgagaga

SEQ ID NO: 217321 - DNA, 25 bp, E. coli
caagaattaaacctaaaatcagata

SEQ ID NO: 217322 - DNA, 25 bp, E. coli
caagaattaaacgtaaaatcagata

SEQ ID NO: 217323 - DNA, 25 bp, E. coli
caaatggcatcactgttatggcagc

SEQ ID NO: 217324 - DNA, 25 bp, E. coli
cagccatattactggtggataacca

SEQ ID NO: 217325 - DNA, 25 bp, E. coli
caacaaaatgttgtagagacggttt

SEQ ID NO: 217326 - DNA, 25 bp, E. coli
cagccatattacaggtggataacca

SEQ ID NO: 217327 - DNA, 25 bp, E. coli
cactcttgataatcaagaattaaac

SEQ ID NO: 217328 - DNA, 25 bp, E. coli
cactcttgataaacaagaattaaac

SEQ ID NO: 217329 - DNA, 25 bp, E. coli
caaatggcatcagtgttatggcagc

SEQ ID NO: 217330 - DNA, 25 bp, E. coli
caacaaaatgttctagagacggttt

SEQ ID NO: 217331 - DNA, 25 bp, E. coli
aaatggtcgtcatatctttagcaac

SEQ ID NO: 217332 - DNA, 25 bp, E. coli
aaatggtcgtcaaatctttagcaac

SEQ ID NO: 217333 - DNA, 25 bp, E. coli
tatgagcgaaagcaaagagaatatt

SEQ ID NO: 217334 - DNA, 25 bp, E. coli
tatgagcgaaaggaaagagaatatt

SEQ ID NO: 217335 - DNA, 25 bp, E. coli
ttccacgtccgtcttacaagctgat

SEQ ID NO: 217336 - DNA, 25 bp, E. coli
ttccacgtccgtgttacaagctgat

SEQ ID NO: 217337 - DNA, 25 bp, E. coli
tttgtcattaaattttccacgtccg

SEQ ID NO: 217338 - DNA, 25 bp, E. coli
tttgtcattaaaatttccacgtccg

SEQ ID NO: 217339 - DNA, 25 bp, E. coli
ttcaattcattgacagaaacaggat

SEQ ID NO: 217340 - DNA, 25 bp, E. coli
ttcaattcattgtcagaaacaggat

SEQ ID NO: 217341 - DNA, 25 bp, E. coli
ggcatcagtgttttggcagccatat

SEQ ID NO: 217342 - DNA, 25 bp, E. coli
ggcatcagtgttatggcagccatat

SEQ ID NO: 217343 - DNA, 25 bp, E. coli
agcgatccgaattgctcaatgtacg

SEQ ID NO: 217344 - DNA, 25 bp, E. coli
agcgatccgaatagctcaatgtacg

SEQ ID NO: 217345 - DNA, 25 bp, E. coli
tagctcaatgtacgaggaagaagac

SEQ ID NO: 217346 - DNA, 25 bp, E. coli
tagctcaatgtaggaggaagaagac

SEQ ID NO: 217347 - DNA, 25 bp, E. coli
tgagcgatccgattagctcaatgta

SEQ ID NO: 217348 - DNA, 25 bp, E. coli
tgagcgatccgaatagctcaatgta

SEQ ID NO: 217349 - DNA, 25 bp, E. coli
tccgaatagctcaatgtacgaggaa

SEQ ID NO: 217350 - DNA, 25 bp, E. coli
tccgaatagctctatgtacgaggaa

SEQ ID NO: 217351 - DNA, 25 bp, E. coli
gctcaatgtacgaggaagaagacga

SEQ ID NO: 217352 - DNA, 25 bp, E. coli
gctcaatgtacgtggaagaagacga

SEQ ID NO: 217353 - DNA, 25 bp, E. coli
gcgatccgaatagctcaatgtacga

SEQ ID NO: 217354 - DNA, 25 bp, E. coli
gcgatccgaatacctcaatgtacga

SEQ ID NO: 217355 - DNA, 25 bp, E. coli
cgatccgaataggtcaatgtacgag

SEQ ID NO: 217356 - DNA, 25 bp, E. coli
ccgaatagctcaatgtacgaggaag

SEQ ID NO: 217357 - DNA, 25 bp, E. coli
cgatccgaatagctcaatgtacgag

SEQ ID NO: 217358 - DNA, 25 bp, E. coli
ccgaatagctcattgtacgaggaag

SEQ ID NO: 217359 - DNA, 25 bp, E. coli
ctcaatgtacgacgaagaagacgat

SEQ ID NO: 217360 - DNA, 25 bp, E. coli
ctcaatgtacgaggaagaagacgat

SEQ ID NO: 217361 - DNA, 25 bp, E. coli
gagcgatccgaaaagctcaatgtac

SEQ ID NO: 217362 - DNA, 25 bp, E. coli
gagcgatccgaatagctcaatgtac

SEQ ID NO: 217363 - DNA, 25 bp, E. coli
gatccgaatagctcaatgtacgagg

SEQ ID NO: 217364 - DNA, 25 bp, E. coli
gatccgaatagcacaatgtacgagg

SEQ ID NO: 217365 - DNA, 25 bp, E. coli
cactggaagcgtttgctgcggcctg

SEQ ID NO: 217366 - DNA, 25 bp, E. coli
cactggaagcgtatgctgcggcctg

SEQ ID NO: 217367 - DNA, 25 bp, E. coli
cagcatgcgcttcgtgtcatggaag

SEQ ID NO: 217368 - DNA, 25 bp, E. coli
catcgcctgtgtctatggcctgaaa

SEQ ID NO: 217369 - DNA, 25 bp, E. coli
cagcatgcgcttggtgtcatggaag

SEQ ID NO: 217370 - DNA, 25 bp, E. coli
catcgcctgtgtgtatggcctgaaa

SEQ ID NO: 217371 - DNA, 25 bp, E. coli
aagcgattagccacccacagaagag

SEQ ID NO: 217372 - DNA, 25 bp, E. coli
aagcgattagcctcccacagaagag

SEQ ID NO: 217373 - DNA, 25 bp, E. coli
tagcactgggcaacaatatcgcagg

SEQ ID NO: 217374 - DNA, 25 bp, E. coli
tatggcctgaaagaattcccggagg

SEQ ID NO: 217375 - DNA, 25 bp, E. coli
tatcgcaggtcagaaagagctcctg

SEQ ID NO: 217376 - DNA, 25 bp, E. coli
tagcactgggcatcaatatcgcagg

SEQ ID NO: 217377 - DNA, 25 bp, E. coli
tatggcctgaaacaattcccggagg

SEQ ID NO: 217378 - DNA, 25 bp, E. coli
tatcgcaggtcacaaagagctcctg

SEQ ID NO: 217379 - DNA, 25 bp, E. coli
tgggactgccgctatccgcagataa

SEQ ID NO: 217380 - DNA, 25 bp, E. coli
tgggactgccgcaatccgcagataa

SEQ ID NO: 217381 - DNA, 25 bp, E. coli
gaaaaaccgcggactgaacgatatc

SEQ ID NO: 217382 - DNA, 25 bp, E. coli
gaaaaaccgcggtctgaacgatatc

SEQ ID NO: 217383 - DNA, 25 bp, E. coli
cggaggcccgcatccagttatgcat

SEQ ID NO: 217384 - DNA, 25 bp, E. coli
cggaggcccgcaaccagttatgcat

SEQ ID NO: 217385 - DNA, 25 bp, E. coli
tcactcgcgacctgaaagcgattag

SEQ ID NO: 217386 - DNA, 25 bp, E. coli
tcactcgcgaccagaaagcgattag

SEQ ID NO: 217387 - DNA, 25 bp, E. coli
aattcaccggcgctgcggatcccgg

SEQ ID NO: 217388 - DNA, 25 bp, E. coli
aattcaccggcggtgcggatcccgg

SEQ ID NO: 217389 - DNA, 25 bp, E. coli
taaagagcccgtttttacgcttgct

SEQ ID NO: 217390 - DNA, 25 bp, E. coli
taaagagcccgtatttacgcttgct

SEQ ID NO: 217391 - DNA, 25 bp, E. coli
tacgcttgctgaactggtcaacgac

SEQ ID NO: 217392 - DNA, 25 bp, E. coli
tacgcttgctgatctggtcaacgac

SEQ ID NO: 217393 - DNA, 25 bp, E. coli
tattgagccagtccgtaaagagccc

SEQ ID NO: 217394 - DNA, 25 bp, E. coli
tattgagccagtgcgtaaagagccc

SEQ ID NO: 217395 - DNA, 25 bp, E. coli
tgatccacagtaccgtaaagcgttg

SEQ ID NO: 217396 - DNA, 25 bp, E. coli
tggtcaacgacaacacgccggaaaa

SEQ ID NO: 217397 - DNA, 25 bp, E. coli
tggtcaacgacatcacgccggaaaa

SEQ ID NO: 217398 - DNA, 25 bp, E. coli
tgatccacagtagcgtaaagcgttg

SEQ ID NO: 217399 - DNA, 25 bp, E. coli
gaagattgacctggtggatggcaaa

SEQ ID NO: 217400 - DNA, 25 bp, E. coli
gaagattgacctcgtggatggcaaa

SEQ ID NO: 217401 - DNA, 25 bp, E. coli
gaaaacctccaccagaatatcgact

SEQ ID NO: 217402 - DNA, 25 bp, E. coli
gaaaacctccacgagaatatcgact

SEQ ID NO: 217403 - DNA, 25 bp, E. coli
gatcccggctaccttaatgcaggcg

SEQ ID NO: 217404 - DNA, 25 bp, E. coli
taatgcaggcgcacaatctgaatat

SEQ ID NO: 217405 - DNA, 25 bp, E. coli
taatgcaggcgctcaatctgaatat

SEQ ID NO: 217406 - DNA, 25 bp, E. coli
gatcccggctacgttaatgcaggcg

SEQ ID NO: 217407 - DNA, 25 bp, E. coli
gagagccgaaagataaggaagtctg

SEQ ID NO: 217408 - DNA, 25 bp, E. coli
gagagccgaaagttaaggaagtctg

SEQ ID NO: 217409 - DNA, 25 bp, E. coli
cacgctggcagacttttcgcaaagt

SEQ ID NO: 217410 - DNA, 25 bp, E. coli
cacgctggcagagttttcgcaaagt

SEQ ID NO: 217411 - DNA, 25 bp, E. coli
tatcgccgggaatatcgcctggaaa

SEQ ID NO: 217412 - DNA, 25 bp, E. coli
tatcgcctggaaaacagaagtgacg

SEQ ID NO: 217413 - DNA, 25 bp, E. coli
tacccgcagcctcggtgagtttggc

SEQ ID NO: 217414 - DNA, 25 bp, E. coli
tacccgcagcctgggtgagtttggc

SEQ ID NO: 217415 - DNA, 25 bp, E. coli
tatcgccgggaaaatcgcctggaaa

SEQ ID NO: 217416 - DNA, 25 bp, E. coli
tatcgcctggaatacagaagtgacg

SEQ ID NO: 217417 - DNA, 25 bp, E. coli
ttttcgcaaagtggtgcagccggaa

SEQ ID NO: 217418 - DNA, 25 bp, E. coli
ttttcgcaaagtcgtgcagccggaa

SEQ ID NO: 217419 - DNA, 25 bp, E. coli
cctggaaaacagaagtgacgtcgct

SEQ ID NO: 217420 - DNA, 25 bp, E. coli
cctggaaaacagtagtgacgtcgct

SEQ ID NO: 217421 - DNA, 25 bp, E. coli
gcgcaacacgctggcagagttttcg

SEQ ID NO: 217422 - DNA, 25 bp, E. coli
gcgcaacacgctcgcagagttttcg

SEQ ID NO: 217423 - DNA, 25 bp, E. coli
cgtttcttcaagacgcgtgctgccg

SEQ ID NO: 217424 - DNA, 25 bp, E. coli
cgtttcttcaagtcgcgtgctgccg

SEQ ID NO: 217425 - DNA, 25 bp, E. coli
gtttgccgtttcatcaagacgcgtg

SEQ ID NO: 217426 - DNA, 25 bp, E. coli
gtcgtttacccggagcctcggtgag

SEQ ID NO: 217427 - DNA, 25 bp, E. coli
gtcgtttacccgcagcctcggtgag

SEQ ID NO: 217428 - DNA, 25 bp, E. coli
gtttgccgtttcttcaagacgcgtg

SEQ ID NO: 217429 - DNA, 25 bp, E. coli
gagttttcgcaaagtggtgcagccg

SEQ ID NO: 217430 - DNA, 25 bp, E. coli
gagttttcgcaatgtggtgcagccg

SEQ ID NO: 217431 - DNA, 25 bp, E. coli
tatgcaggcgagctataaggccaca

SEQ ID NO: 217432 - DNA, 25 bp, E. coli
tatgcaggcgaggtataaggccaca

SEQ ID NO: 217433 - DNA, 25 bp, E. coli
ttacccgcggagatatgaaactgca

SEQ ID NO: 217434 - DNA, 25 bp, E. coli
ttagcagcaatccatttcacgccgc

SEQ ID NO: 217435 - DNA, 25 bp, E. coli
ttacccgcggagttatgaaactgca

SEQ ID NO: 217436 - DNA, 25 bp, E. coli
ttagcagcaatcgatttcacgccgc

SEQ ID NO: 217437 - DNA, 25 bp, E. coli
tgctgaagcatggagtcttgccctg

SEQ ID NO: 217438 - DNA, 25 bp, E. coli
tgcagcactgtcgtcagtcagcggg

SEQ ID NO: 217439 - DNA, 25 bp, E. coli
tgctgaagcatgcagtcttgccctg

SEQ ID NO: 217440 - DNA, 25 bp, E. coli
tgcagcactgtcctcagtcagcggg

SEQ ID NO: 217441 - DNA, 25 bp, E. coli
tcagatattcacgagccggagttgc

SEQ ID NO: 217442 - DNA, 25 bp, E. coli
tcagatattcaccagccggagttgc

SEQ ID NO: 217443 - DNA, 25 bp, E. coli
gaatgatgcctcagacggaatcgct

SEQ ID NO: 217444 - DNA, 25 bp, E. coli
gaatgatgcctctgacggaatcgct

SEQ ID NO: 217445 - DNA, 25 bp, E. coli
cctccggagaacagggtgcatctta

SEQ ID NO: 217446 - DNA, 25 bp, E. coli
cctccggagaactgggtgcatctta

SEQ ID NO: 217447 - DNA, 25 bp, E. coli
gatattcaccttcagggctgcagca

SEQ ID NO: 217448 - DNA, 25 bp, E. coli
gatattcaccttgagggctgcagca

SEQ ID NO: 217449 - DNA, 25 bp, E. coli
ggtaaaacttaatcagcctccggag

SEQ ID NO: 217450 - DNA, 25 bp, E. coli
ggtaaaacttaaacagcctccggag

SEQ ID NO: 217451 - DNA, 25 bp, E. coli
ggcatgtcatgcatccgggaggaaa

SEQ ID NO: 217452 - DNA, 25 bp, E. coli
ggcatgtcatgcttccgggaggaaa

SEQ ID NO: 217453 - DNA, 25 bp, E. coli
aagtttattggctgcgctggaaacg

SEQ ID NO: 217454 - DNA, 25 bp, E. coli
aagtttattggcagcgctggaaacg

SEQ ID NO: 217455 - DNA, 25 bp, E. coli
caaaggccattagaaatcacacgag

SEQ ID NO: 217456 - DNA, 25 bp, E. coli
cacgagatttgaccgacttctggaa

SEQ ID NO: 217457 - DNA, 25 bp, E. coli
cacgagatttgagcgacttctggaa

SEQ ID NO: 217458 - DNA, 25 bp, E. coli
caaaggccattacaaatcacacgag

SEQ ID NO: 217459 - DNA, 25 bp, E. coli
tactcaacgcgtaagccaggcatcc

SEQ ID NO: 217460 - DNA, 25 bp, E. coli
tactcaacgcgttagccaggcatcc

SEQ ID NO: 217461 - DNA, 25 bp, E. coli
agcgatgctcgatgccaacgacgcg

SEQ ID NO: 217462 - DNA, 25 bp, E. coli
atcaaccgccagaagtgaatctact

SEQ ID NO: 217463 - DNA, 25 bp, E. coli
atcaaccgccagtagtgaatctact

SEQ ID NO: 217464 - DNA, 25 bp, E. coli
agcgatgctcgaagccaacgacgcg

SEQ ID NO: 217465 - DNA, 25 bp, E. coli
tttcacctgcccaaaggccattaca

SEQ ID NO: 217466 - DNA, 25 bp, E. coli
tttcacctgccctaaggccattaca

SEQ ID NO: 217467 - DNA, 25 bp, E. coli
tgatgaaagtttattggcagcgctg

SEQ ID NO: 217468 - DNA, 25 bp, E. coli
tgatgaaagttttttggcagcgctg

SEQ ID NO: 217469 - DNA, 25 bp, E. coli
ccacatatgactggcgtacattcac

SEQ ID NO: 217470 - DNA, 25 bp, E. coli
ccacatatgactcgcgtacattcac

SEQ ID NO: 217471 - DNA, 25 bp, E. coli
gcaagagatgttaggcgaggccacc

SEQ ID NO: 217472 - DNA, 25 bp, E. coli
gcaagagatgtttggcgaggccacc

SEQ ID NO: 217473 - DNA, 25 bp, E. coli
cgttagccaggcttccatgacgcag

SEQ ID NO: 217474 - DNA, 25 bp, E. coli
cgttagccaggcatccatgacgcag

SEQ ID NO: 217475 - DNA, 25 bp, E. coli
caaatccggatatcgaaaccgcgca

SEQ ID NO: 217476 - DNA, 25 bp, E. coli
caaatccggataacgaaaccgcgca

SEQ ID NO: 217477 - DNA, 25 bp, E. coli
catgagatgggcgttttcgcgtccc

SEQ ID NO: 217478 - DNA, 25 bp, E. coli
catgagatgggccttttcgcgtccc

SEQ ID NO: 217479 - DNA, 25 bp, E. coli
aaatatcgacgagcgcggaaaaggc

SEQ ID NO: 217480 - DNA, 25 bp, E. coli
aaatatcgacgaccgcggaaaaggc

SEQ ID NO: 217481 - DNA, 25 bp, E. coli
tagcgtagccgatgaactgatgcgt

SEQ ID NO: 217482 - DNA, 25 bp, E. coli
tagcgtagccgaagaactgatgcgt

SEQ ID NO: 217483 - DNA, 25 bp, E. coli
tgtgccgacgaaaaggtactgattg

SEQ ID NO: 217484 - DNA, 25 bp, E. coli
tgtgccgacgaataggtactgattg

SEQ ID NO: 217485 - DNA, 25 bp, E. coli
tgatgcgtctgaaggaaggccagca

SEQ ID NO: 217486 - DNA, 25 bp, E. coli
tgatgcgtctgatggaaggccagca

SEQ ID NO: 217487 - DNA, 25 bp, E. coli
gccagagatttagcggaacttgccg

SEQ ID NO: 217488 - DNA, 25 bp, E. coli
gccagagatttaccggaacttgccg

SEQ ID NO: 217489 - DNA, 25 bp, E. coli
gaaaatgcaaagcagtgacacgccg

SEQ ID NO: 217490 - DNA, 25 bp, E. coli
gaaaatgcaaaggagtgacacgccg

SEQ ID NO: 217491 - DNA, 25 bp, E. coli
cgaaaaaagtctcccagcgggcgat

SEQ ID NO: 217492 - DNA, 25 bp, E. coli
cgaaaaaagtctgccagcgggcgat

SEQ ID NO: 217493 - DNA, 25 bp, E. coli
tcaaccaggcgattgttgccgcagg

SEQ ID NO: 217494 - DNA, 25 bp, E. coli
tcaaccaggcgaatgttgccgcagg

SEQ ID NO: 217495 - DNA, 25 bp, E. coli
tcaagtttccggctatcggcctgct

SEQ ID NO: 217496 - DNA, 25 bp, E. coli
tcaagtttccgggtatcggcctgct

SEQ ID NO: 217497 - DNA, 25 bp, E. coli
taaaagctattctgcctatgcgtcg

SEQ ID NO: 217498 - DNA, 25 bp, E. coli
taaaagctattcagcctatgcgtcg

SEQ ID NO: 217499 - DNA, 25 bp, E. coli
ccttccttaggttatggtccaacat

SEQ ID NO: 217500 - DNA, 25 bp, E. coli
ccttccttaggtaatggtccaacat

SEQ ID NO: 217501 - DNA, 25 bp, E. coli
aaaatattattcgagagattccgcc

SEQ ID NO: 217502 - DNA, 25 bp, E. coli
aaaatattattccagagattccgcc

SEQ ID NO: 217503 - DNA, 25 bp, E. coli
tatcgataccagtgatgaacatctt

SEQ ID NO: 217504 - DNA, 25 bp, E. coli
tatcgataccagagatgaacatctt

SEQ ID NO: 217505 - DNA, 25 bp, E. coli
tattcataatgacagtaaaccttcc

SEQ ID NO: 217506 - DNA, 25 bp, E. coli
tattcataatgagagtaaaccttcc

SEQ ID NO: 217507 - DNA, 25 bp, E. coli
tctatcctcacagtcgggactcaag

SEQ ID NO: 217508 - DNA, 25 bp, E. coli
tctatcctcacactcgggactcaag

SEQ ID NO: 217509 - DNA, 25 bp, E. coli
gaacatcttgtagaagtaagcgata

SEQ ID NO: 217510 - DNA, 25 bp, E. coli
gaacatcttgtacaagtaagcgata

SEQ ID NO: 217511 - DNA, 25 bp, E. coli
gaaacaatatttactgacgcagaac

SEQ ID NO: 217512 - DNA, 25 bp, E. coli
gaaacaatattttctgacgcagaac

SEQ ID NO: 217513 - DNA, 25 bp, E. coli
cgggcacacccgtctgttattatat

SEQ ID NO: 217514 - DNA, 25 bp, E. coli
cgggcacacccgactgttattatat

SEQ ID NO: 217515 - DNA, 25 bp, E. coli
ggttaagccaatgctttacaacaga

SEQ ID NO: 217516 - DNA, 25 bp, E. coli
ggttaagccaatcctttacaacaga

SEQ ID NO: 217517 - DNA, 25 bp, E. coli
gagattccgccttaatagaagaaga

SEQ ID NO: 217518 - DNA, 25 bp, E. coli
gagattccgcctaaatagaagaaga

SEQ ID NO: 217519 - DNA, 25 bp, E. coli
caacagatgattagctatccggcgg

SEQ ID NO: 217520 - DNA, 25 bp, E. coli
caacagatgatttgctatccggcgg

SEQ ID NO: 217521 - DNA, 25 bp, E. coli
cagttattgaaattgcatgcgccgc

SEQ ID NO: 217522 - DNA, 25 bp, E. coli
cagttattgaaaatgcatgcgccgc

SEQ ID NO: 217523 - DNA, 25 bp, E. coli
caggtgcggaatatgttgcgcctta

SEQ ID NO: 217524 - DNA, 25 bp, E. coli
caggtgcggaatttgttgcgcctta

SEQ ID NO: 217525 - DNA, 25 bp, E. coli
tgtcacgtatttatccgctggcggg

SEQ ID NO: 217526 - DNA, 25 bp, E. coli
tgtcacgtatttttccgctggcggg

SEQ ID NO: 217527 - DNA, 25 bp, E. coli
tctgtttgcccaggtaatggctacc

SEQ ID NO: 217528 - DNA, 25 bp, E. coli
tctgtttgcccacgtaatggctacc

SEQ ID NO: 217529 - DNA, 25 bp, E. coli
gcgagtttcaaatccccgcgtcagg

SEQ ID NO: 217530 - DNA, 25 bp, E. coli
gcgagtttcaaaaccccgcgtcagg

SEQ ID NO: 217531 - DNA, 25 bp, E. coli
gaaccgcggtatatggcgcagcaca

SEQ ID NO: 217532 - DNA, 25 bp, E. coli
gaaccgcggtatttggcgcagcaca

SEQ ID NO: 217533 - DNA, 25 bp, E. coli
gatacttcagaccttgttgcggtga

SEQ ID NO: 217534 - DNA, 25 bp, E. coli
gatacttcagacgttgttgcggtga

SEQ ID NO: 217535 - DNA, 25 bp, E. coli
ggtgtgaccactaacccaagcatta

SEQ ID NO: 217536 - DNA, 25 bp, E. coli
ggtgtgaccacttacccaagcatta

SEQ ID NO: 217537 - DNA, 25 bp, E. coli
tgtgaccgactttcaccagttattg

SEQ ID NO: 217538 - DNA, 25 bp, E. coli
tgtgaccgacttacaccagttattg

SEQ ID NO: 217539 - DNA, 25 bp, E. coli
taatcgtattgatgctcagggcggt

SEQ ID NO: 217540 - DNA, 25 bp, E. coli
taatcgtattgaagctcagggcggt

SEQ ID NO: 217541 - DNA, 25 bp, E. coli
aattattaaaagttcgccgcgcctc

SEQ ID NO: 217542 - DNA, 25 bp, E. coli
aattattaaaagatcgccgcgcctc

SEQ ID NO: 217543 - DNA, 25 bp, E. coli
cagtccatatatactagcgtcgcga

SEQ ID NO: 217544 - DNA, 25 bp, E. coli
cagtccatatattctagcgtcgcga

SEQ ID NO: 217545 - DNA, 25 bp, E. coli
tgtttcaaccgctggacgatcagga

SEQ ID NO: 217546 - DNA, 25 bp, E. coli
tgtttcaaccgcaggacgatcagga

SEQ ID NO: 217547 - DNA, 25 bp, E. coli
tgaaccggcttgaagcgcctatccg

SEQ ID NO: 217548 - DNA, 25 bp, E. coli
tgaaccggcttgtagcgcctatccg

SEQ ID NO: 217549 - DNA, 25 bp, E. coli
tccgcttttcggcagaatggtacag

SEQ ID NO: 217550 - DNA, 25 bp, E. coli
tccgcttttcgggagaatggtacag

SEQ ID NO: 217551 - DNA, 25 bp, E. coli
tcttccggagcggatatggttcagc

SEQ ID NO: 217552 - DNA, 25 bp, E. coli
tctattttcatgcaggcagggaggc

SEQ ID NO: 217553 - DNA, 25 bp, E. coli
tctattttcatggaggcagggaggc

SEQ ID NO: 217554 - DNA, 25 bp, E. coli
tcttccggagcgcatatggttcagc

SEQ ID NO: 217555 - DNA, 25 bp, E. coli
ccgatgtttatcaggtatagccccg

SEQ ID NO: 217556 - DNA, 25 bp, E. coli
ccgatgtttatctggtatagccccg

SEQ ID NO: 217557 - DNA, 25 bp, E. coli
tgtattttgccgaccacggcctgga

SEQ ID NO: 217558 - DNA, 25 bp, E. coli
tgtattttgccgtccacggcctgga

SEQ ID NO: 217559 - DNA, 25 bp, E. coli
tggatatacacgctctacgacaccg

SEQ ID NO: 217560 - DNA, 25 bp, E. coli
ggaacagccgcatacgcttgaggaa

SEQ ID NO: 217561 - DNA, 25 bp, E. coli
ggaacagccgcaaacgcttgaggaa

SEQ ID NO: 217562 - DNA, 25 bp, E. coli
tggatatacacggtctacgacaccg

SEQ ID NO: 217563 - DNA, 25 bp, E. coli
cagcgcatttgagtgccccggtcat

SEQ ID NO: 217564 - DNA, 25 bp, E. coli
caaagaattttatggtcgtcagtta

SEQ ID NO: 217565 - DNA, 25 bp, E. coli
caaagaattttaaggtcgtcagtta

SEQ ID NO: 217566 - DNA, 25 bp, E. coli
cagcgcatttgactgccccggtcat

SEQ ID NO: 217567 - DNA, 25 bp, E. coli
catcgtgcatgcctgaatatagacg

SEQ ID NO: 217568 - DNA, 25 bp, E. coli
catcgtgcatgcgtgaatatagacg

SEQ ID NO: 217569 - DNA, 25 bp, E. coli
catggagaagcaggcaaagaatttt

SEQ ID NO: 217570 - DNA, 25 bp, E. coli
catggagaagcacgcaaagaatttt

SEQ ID NO: 217571 - DNA, 25 bp, E. coli
tacgcaatccgtacataaacagcag

SEQ ID NO: 217572 - DNA, 25 bp, E. coli
aaaactgctggaatctgatgcgccg

SEQ ID NO: 217573 - DNA, 25 bp, E. coli
aaaactgctggattctgatgcgccg

SEQ ID NO: 217574 - DNA, 25 bp, E. coli
tacgcaatccgttcataaacagcag

SEQ ID NO: 217575 - DNA, 25 bp, E. coli
tccgtacataaacagcaggctggtt

SEQ ID NO: 217576 - DNA, 25 bp, E. coli
tgctggaatctgttgcgccgctggc

SEQ ID NO: 217577 - DNA, 25 bp, E. coli
tgctggaatctgatgcgccgctggc

SEQ ID NO: 217578 - DNA, 25 bp, E. coli
tccgtacataaagagcaggctggtt

SEQ ID NO: 217579 - DNA, 25 bp, E. coli
tctggtgtcttccaacatggagaag

SEQ ID NO: 217580 - DNA, 25 bp, E. coli
tctggtgtcttcgaacatggagaag

SEQ ID NO: 217581 - DNA, 25 bp, E. coli
gcatgcgtgaatatagacgaaagta

SEQ ID NO: 217582 - DNA, 25 bp, E. coli
gcatgcgtgaatttagacgaaagta

SEQ ID NO: 217583 - DNA, 25 bp, E. coli
ggcaacagcgcaattgactgccccg

SEQ ID NO: 217584 - DNA, 25 bp, E. coli
ggcaacagcgcatttgactgccccg

SEQ ID NO: 217585 - DNA, 25 bp, E. coli
agttctccactattgtcagttcagg

SEQ ID NO: 217586 - DNA, 25 bp, E. coli
agttctccactaatgtcagttcagg

SEQ ID NO: 217587 - DNA, 25 bp, E. coli
tatagggcccatagcggtcctggcg

SEQ ID NO: 217588 - DNA, 25 bp, E. coli
tatagggcccattgcggtcctggcg

SEQ ID NO: 217589 - DNA, 25 bp, E. coli
tataccgcgaggactccggcgatat

SEQ ID NO: 217590 - DNA, 25 bp, E. coli
tataccgcgaggtctccggcgatat

SEQ ID NO: 217591 - DNA, 25 bp, E. coli
tgctcatcaggcaggtatagggccc

SEQ ID NO: 217592 - DNA, 25 bp, E. coli
tgctcatcaggctggtatagggccc

SEQ ID NO: 217593 - DNA, 25 bp, E. coli
tcagggtgatgctcatcaggcaggt

SEQ ID NO: 217594 - DNA, 25 bp, E. coli
tcatcaggcaggtatagggcccatt

SEQ ID NO: 217595 - DNA, 25 bp, E. coli
tcaggcaggtattgggcccattgcg

SEQ ID NO: 217596 - DNA, 25 bp, E. coli
tcagggtgatgcacatcaggcaggt

SEQ ID NO: 217597 - DNA, 25 bp, E. coli
tcaggcaggtatagggcccattgcg

SEQ ID NO: 217598 - DNA, 25 bp, E. coli
tcatcaggcaggaatagggcccatt

SEQ ID NO: 217599 - DNA, 25 bp, E. coli
gcgttcggcgtaaaccgcgaggact

SEQ ID NO: 217600 - DNA, 25 bp, E. coli
gcgttcggcgtataccgcgaggact

SEQ ID NO: 217601 - DNA, 25 bp, E. coli
gactccggcgatttccggaacgtcc

SEQ ID NO: 217602 - DNA, 25 bp, E. coli
gactccggcgatatccggaacgtcc

SEQ ID NO: 217603 - DNA, 25 bp, E. coli
gttcggcgtatagcgcgaggactcc

SEQ ID NO: 217604 - DNA, 25 bp, E. coli
gttcggcgtataccgcgaggactcc

SEQ ID NO: 217605 - DNA, 25 bp, E. coli
gtcctggcggcgttcggcgtatacc

SEQ ID NO: 217606 - DNA, 25 bp, E. coli
gtcctggcggcgatcggcgtatacc

SEQ ID NO: 217607 - DNA, 25 bp, E. coli
catggctgtcaggtgcgacatctgc

SEQ ID NO: 217608 - DNA, 25 bp, E. coli
catggctgtcagctgcgacatctgc

SEQ ID NO: 217609 - DNA, 25 bp, E. coli
tcatggctgtcacctgcgacatctg

SEQ ID NO: 217610 - DNA, 25 bp, E. coli
tcatggctgtcagctgcgacatctg

SEQ ID NO: 217611 - DNA, 25 bp, E. coli
gcctccggattgcccgcaacgaaat

SEQ ID NO: 217612 - DNA, 25 bp, E. coli
gccgtcatggctgtcagctgcgaca

SEQ ID NO: 217613 - DNA, 25 bp, E. coli
gccgtcatggctctcagctgcgaca

SEQ ID NO: 217614 - DNA, 25 bp, E. coli
gcctccggattggccgcaacgaaat

SEQ ID NO: 217615 - DNA, 25 bp, E. coli
cgaggccgtcatcgctgtcagctgc

SEQ ID NO: 217616 - DNA, 25 bp, E. coli
ccgtcatggctgtcagctgcgacat

SEQ ID NO: 217617 - DNA, 25 bp, E. coli
cgaggccgtcatggctgtcagctgc

SEQ ID NO: 217618 - DNA, 25 bp, E. coli
ccgtcatggctgacagctgcgacat

SEQ ID NO: 217619 - DNA, 25 bp, E. coli
cgtcatggctgtcagctgcgacatc

SEQ ID NO: 217620 - DNA, 25 bp, E. coli
ctccggattgcccgcaacgaaattc

SEQ ID NO: 217621 - DNA, 25 bp, E. coli
cgtcatggctgtgagctgcgacatc

SEQ ID NO: 217622 - DNA, 25 bp, E. coli
ctccggattgccggcaacgaaattc

SEQ ID NO: 217623 - DNA, 25 bp, E. coli
gtcatggctgtcagctgcgacatct

SEQ ID NO: 217624 - DNA, 25 bp, E. coli
gtcatggctgtctgctgcgacatct

SEQ ID NO: 217625 - DNA, 25 bp, E. coli
tggctgtcagctgcgacatctgctc

SEQ ID NO: 217626 - DNA, 25 bp, E. coli
ggccgtcatggctgtcagctgcgac

SEQ ID NO: 217627 - DNA, 25 bp, E. coli
ggccgtcatggcagtcagctgcgac

SEQ ID NO: 217628 - DNA, 25 bp, E. coli
tggctgtcagctccgacatctgctc

SEQ ID NO: 217629 - DNA, 25 bp, E. coli
caaggctgaaagttattgcgtcgaa

SEQ ID NO: 217630 - DNA, 25 bp, E. coli
caaggctgaaagatattgcgtcgaa

SEQ ID NO: 217631 - DNA, 25 bp, E. coli
taaaaacagtaaagatccggcagaa

SEQ ID NO: 217632 - DNA, 25 bp, E. coli
taaaaacagtaatgatccggcagaa

SEQ ID NO: 217633 - DNA, 25 bp, E. coli
agttcagcgtgtcctagcgcaaggc

SEQ ID NO: 217634 - DNA, 25 bp, E. coli
agttcagcgtgtgctagcgcaaggc

SEQ ID NO: 217635 - DNA, 25 bp, E. coli
aaagatattgcctgtgataaggagg

SEQ ID NO: 217636 - DNA, 25 bp, E. coli
aaagatattgccagtgataaggagg

SEQ ID NO: 217637 - DNA, 25 bp, E. coli
tccggcagaacgtgaaaaggtacag

SEQ ID NO: 217638 - DNA, 25 bp, E. coli
tccggcagaacgagaaaaggtacag

SEQ ID NO: 217639 - DNA, 25 bp, E. coli
gctgcctgcagttatggtaatgcgg

SEQ ID NO: 217640 - DNA, 25 bp, E. coli
gctgcctgcagtaatggtaatgcgg

SEQ ID NO: 217641 - DNA, 25 bp, E. coli
gcaaaacagacgcttaaaaacagta

SEQ ID NO: 217642 - DNA, 25 bp, E. coli
gcaaaacagacggttaaaaacagta

SEQ ID NO: 217643 - DNA, 25 bp, E. coli
gaacttgagatagcaaaacagacgc

SEQ ID NO: 217644 - DNA, 25 bp, E. coli
gaacttgagataccaaaacagacgc

SEQ ID NO: 217645 - DNA, 25 bp, E. coli
cattgcttgaaatagatattgccag

SEQ ID NO: 217646 - DNA, 25 bp, E. coli
cattgcttgaaaaagatattgccag

SEQ ID NO: 217647 - DNA, 25 bp, E. coli
gataaggaggtttttgctgcctgca

SEQ ID NO: 217648 - DNA, 25 bp, E. coli
ggtacagcagaattatgatgcattg

SEQ ID NO: 217649 - DNA, 25 bp, E. coli
ggtacagcagaaatatgatgcattg

SEQ ID NO: 217650 - DNA, 25 bp, E. coli
gataaggaggttattgctgcctgca

SEQ ID NO: 217651 - DNA, 25 bp, E. coli
caatggcaggcagatcgttagttca

SEQ ID NO: 217652 - DNA, 25 bp, E. coli
caatggcaggcacatcgttagttca

SEQ ID NO: 217653 - DNA, 25 bp, E. coli
caacaatggttccagcaggagcaga

SEQ ID NO: 217654 - DNA, 25 bp, E. coli
caacaatggttcgagcaggagcaga

SEQ ID NO: 217655 - DNA, 25 bp, E. coli
cagaaagttgatgagcagtgcggca

SEQ ID NO: 217656 - DNA, 25 bp, E. coli
cagtgcggcaaatgagtggatccaa

SEQ ID NO: 217657 - DNA, 25 bp, E. coli
cagaaagttgatcagcagtgcggca

SEQ ID NO: 217658 - DNA, 25 bp, E. coli
cagtgcggcaaaagagtggatccaa

SEQ ID NO: 217659 - DNA, 25 bp, E. coli
taaacctgcggttaccagagctgca

SEQ ID NO: 217660 - DNA, 25 bp, E. coli
taaacctgcggtaaccagagctgca

SEQ ID NO: 217661 - DNA, 25 bp, E. coli
tatgaggttcatgcccgtgcagtcg

SEQ ID NO: 217662 - DNA, 25 bp, E. coli
tagttcaggcgactgcacagacgct

SEQ ID NO: 217663 - DNA, 25 bp, E. coli
tagttcaggcgagtgcacagacgct

SEQ ID NO: 217664 - DNA, 25 bp, E. coli
tatgaggttcatccccgtgcagtcg

SEQ ID NO: 217665 - DNA, 25 bp, E. coli
ttttagagcatgtacaggatacccg

SEQ ID NO: 217666 - DNA, 25 bp, E. coli
ttttagagcatgaacaggatacccg

SEQ ID NO: 217667 - DNA, 25 bp, E. coli
tgactaaccaactcctgcaggctgt

SEQ ID NO: 217668 - DNA, 25 bp, E. coli
tgactaaccaacacctgcaggctgt

SEQ ID NO: 217669 - DNA, 25 bp, E. coli
tcgtaatggcgatacccaacaatgg

SEQ ID NO: 217670 - DNA, 25 bp, E. coli
tcgtaatggcgaaacccaacaatgg

SEQ ID NO: 217671 - DNA, 25 bp, E. coli
ggctgtagccaatcaaactcgtaat

SEQ ID NO: 217672 - DNA, 25 bp, E. coli
ggctgtagccaaacaaactcgtaat

SEQ ID NO: 217673 - DNA, 25 bp, E. coli
catcggcaccatcctgacagcgagt

SEQ ID NO: 217674 - DNA, 25 bp, E. coli
catcggcaccatgctgacagcgagt

SEQ ID NO: 217675 - DNA, 25 bp, E. coli
agttggttcttcaggcttgtctcgc

SEQ ID NO: 217676 - DNA, 25 bp, E. coli
aggtctgcctgagcggtgactccga

SEQ ID NO: 217677 - DNA, 25 bp, E. coli
aggtctgcctgaccggtgactccga

SEQ ID NO: 217678 - DNA, 25 bp, E. coli
atgccgggcaatcgcaggtctgcct

SEQ ID NO: 217679 - DNA, 25 bp, E. coli
agttggttcttctggcttgtctcgc

SEQ ID NO: 217680 - DNA, 25 bp, E. coli
atgccgggcaatggcaggtctgcct

SEQ ID NO: 217681 - DNA, 25 bp, E. coli
tacctgttagctcatatcccttcgc

SEQ ID NO: 217682 - DNA, 25 bp, E. coli
tacctgttagctgatatcccttcgc

SEQ ID NO: 217683 - DNA, 25 bp, E. coli
tgaccggtgactgcgactggttcga

SEQ ID NO: 217684 - DNA, 25 bp, E. coli
tgaccggtgactccgactggttcga

SEQ ID NO: 217685 - DNA, 25 bp, E. coli
tctggcttgtctcgcccgtttgcgg

SEQ ID NO: 217686 - DNA, 25 bp, E. coli
tctggcttgtctggcccgtttgcgg

SEQ ID NO: 217687 - DNA, 25 bp, E. coli
gctcctgctgcaagtctgtataacg

SEQ ID NO: 217688 - DNA, 25 bp, E. coli
gctcctgctgcatgtctgtataacg

SEQ ID NO: 217689 - DNA, 25 bp, E. coli
gactggttcgataatgctcctgctg

SEQ ID NO: 217690 - DNA, 25 bp, E. coli
ctgtataacggcatcccacgcatcg

SEQ ID NO: 217691 - DNA, 25 bp, E. coli
ctgtataacggcttcccacgcatcg

SEQ ID NO: 217692 - DNA, 25 bp, E. coli
ctgatatcccttcgcttccttcagg

SEQ ID NO: 217693 - DNA, 25 bp, E. coli
ctgatatcccttggcttccttcagg

SEQ ID NO: 217694 - DNA, 25 bp, E. coli
gactggttcgattatgctcctgctg

SEQ ID NO: 217695 - DNA, 25 bp, E. coli
catcgcgggtgtagaagaaaaatta

SEQ ID NO: 217696 - DNA, 25 bp, E. coli
catcgcgggtgttgaagaaaaatta

SEQ ID NO: 217697 - DNA, 25 bp, E. coli
tacaaaggtgacaaggtgcttaagc

SEQ ID NO: 217698 - DNA, 25 bp, E. coli
tacaaaggtgactaggtgcttaagc

SEQ ID NO: 217699 - DNA, 25 bp, E. coli
tacctacgcgcacgaaaacgtgact

SEQ ID NO: 217700 - DNA, 25 bp, E. coli
tacctacgcgcaggaaaacgtgact

SEQ ID NO: 217701 - DNA, 25 bp, E. coli
tgcagggtatttgaggaatcaacgt

SEQ ID NO: 217702 - DNA, 25 bp, E. coli
tgcagggtatttcaggaatcaacgt

SEQ ID NO: 217703 - DNA, 25 bp, E. coli
tctgaacggcactgaaattgccatt

SEQ ID NO: 217704 - DNA, 25 bp, E. coli
tctgaacggcacagaaattgccatt

SEQ ID NO: 217705 - DNA, 25 bp, E. coli
gaatcaacgtttctgctgaagatgc

SEQ ID NO: 217706 - DNA, 25 bp, E. coli
gaatcaacgtttgtgctgaagatgc

SEQ ID NO: 217707 - DNA, 25 bp, E. coli
gaaagccgctggatttaaagaagtg

SEQ ID NO: 217708 - DNA, 25 bp, E. coli
gaaagccgctggttttaaagaagtg

SEQ ID NO: 217709 - DNA, 25 bp, E. coli
gaaattcagcgccaatctgaacggc

SEQ ID NO: 217710 - DNA, 25 bp, E. coli
gaaattcagcgcgaatctgaacggc

SEQ ID NO: 217711 - DNA, 25 bp, E. coli
ctggctgcggtgacaaagaagaatc

SEQ ID NO: 217712 - DNA, 25 bp, E. coli
ctggctgcggtgtcaaagaagaatc

SEQ ID NO: 217713 - DNA, 25 bp, E. coli
gtggattttaaacccctgcagggta

SEQ ID NO: 217714 - DNA, 25 bp, E. coli
gtggattttaaagccctgcagggta

SEQ ID NO: 217715 - DNA, 25 bp, E. coli
tcactatggcgctaatggaactggt

SEQ ID NO: 217716 - DNA, 25 bp, E. coli
tcactatggcgcaaatggaactggt

SEQ ID NO: 217717 - DNA, 25 bp, E. coli
caatttgccttcaaaaccggtctgg

SEQ ID NO: 217718 - DNA, 25 bp, E. coli
caatttgccttctaaaccggtctgg

SEQ ID NO: 217719 - DNA, 25 bp, E. coli
cacgttgaggagaatcgcaagcgac

SEQ ID NO: 217720 - DNA, 25 bp, E. coli
cacgttgaggagtatcgcaagcgac

SEQ ID NO: 217721 - DNA, 25 bp, E. coli
agtaagctgattgtcccgcagtggc

SEQ ID NO: 217722 - DNA, 25 bp, E. coli
agtaagctgattctcccgcagtggc

SEQ ID NO: 217723 - DNA, 25 bp, E. coli
tattctcgcctggttagggccggca

SEQ ID NO: 217724 - DNA, 25 bp, E. coli
tattctcgcctgcttagggccggca

SEQ ID NO: 217725 - DNA, 25 bp, E. coli
tcgcgaggcgtttatggcagtagac

SEQ ID NO: 217726 - DNA, 25 bp, E. coli
tcgcgaggcgttaatggcagtagac

SEQ ID NO: 217727 - DNA, 25 bp, E. coli
tcggcggcgaccgttgtacatatac

SEQ ID NO: 217728 - DNA, 25 bp, E. coli
tctggcttgagcaggtacacggcaa

SEQ ID NO: 217729 - DNA, 25 bp, E. coli
tcggcggcgacccttgtacatatac

SEQ ID NO: 217730 - DNA, 25 bp, E. coli
tctggcttgagctggtacacggcaa

SEQ ID NO: 217731 - DNA, 25 bp, E. coli
ccaaaaggtgttccggcctgtagct

SEQ ID NO: 217732 - DNA, 25 bp, E. coli
ccaaaaggtgttgcggcctgtagct

SEQ ID NO: 217733 - DNA, 25 bp, E. coli
gctgttttgcaatcgagcgggaacg

SEQ ID NO: 217734 - DNA, 25 bp, E. coli
gctgttttgcaaacgagcgggaacg

SEQ ID NO: 217735 - DNA, 25 bp, E. coli
gcaagcgactttatgctgcgggcaa

SEQ ID NO: 217736 - DNA, 25 bp, E. coli
gcaagcgactttttgctgcgggcaa

SEQ ID NO: 217737 - DNA, 25 bp, E. coli
gatgcctcttattgcaatacgcccg

SEQ ID NO: 217738 - DNA, 25 bp, E. coli
gatgcctcttatagcaatacgcccg

SEQ ID NO: 217739 - DNA, 25 bp, E. coli
caacctggatttggacttagcatca

SEQ ID NO: 217740 - DNA, 25 bp, E. coli
cagcatttaacgtccctgactggtt

SEQ ID NO: 217741 - DNA, 25 bp, E. coli
cacatgtttggccagaaagagtcac

SEQ ID NO: 217742 - DNA, 25 bp, E. coli
cagcatttaacgaccctgactggtt

SEQ ID NO: 217743 - DNA, 25 bp, E. coli
caacctggatttcgacttagcatca

SEQ ID NO: 217744 - DNA, 25 bp, E. coli
cacatgtttggcgagaaagagtcac

SEQ ID NO: 217745 - DNA, 25 bp, E. coli
catggaattaagacgaaagctcggt

SEQ ID NO: 217746 - DNA, 25 bp, E. coli
catggaattaagtcgaaagctcggt

SEQ ID NO: 217747 - DNA, 25 bp, E. coli
tattggtatacatgcgccagagcag

SEQ ID NO: 217748 - DNA, 25 bp, E. coli
tattggtatacaagcgccagagcag

SEQ ID NO: 217749 - DNA, 25 bp, E. coli
tttattggctaaacagggaggcaac

SEQ ID NO: 217750 - DNA, 25 bp, E. coli
tttattggctaatcagggaggcaac

SEQ ID NO: 217751 - DNA, 25 bp, E. coli
tgtgaaaaaccaccacgcagttcgt

SEQ ID NO: 217752 - DNA, 25 bp, E. coli
tgtgaaaaaccagcacgcagttcgt

SEQ ID NO: 217753 - DNA, 25 bp, E. coli
tcgtcaggcaaagagaaaggccaat

SEQ ID NO: 217754 - DNA, 25 bp, E. coli
tcgtcaggcaaacagaaaggccaat

SEQ ID NO: 217755 - DNA, 25 bp, E. coli
gcatggaaagaacaccgcgatcgat

SEQ ID NO: 217756 - DNA, 25 bp, E. coli
gcatggaaagaagaccgcgatcgat

SEQ ID NO: 217757 - DNA, 25 bp, E. coli
gaaaaatggtgtgtatccggttgcc

SEQ ID NO: 217758 - DNA, 25 bp, E. coli
gaaaaatggtgtctatccggttgcc

SEQ ID NO: 217759 - DNA, 25 bp, E. coli
cgagacattgatgcttacaagcgac

SEQ ID NO: 217760 - DNA, 25 bp, E. coli
cgagacattgatccttacaagcgac

SEQ ID NO: 217761 - DNA, 25 bp, E. coli
aatacagccatgtttattccgtcga

SEQ ID NO: 217762 - DNA, 25 bp, E. coli
aatacagccatgattattccgtcga

SEQ ID NO: 217763 - DNA, 25 bp, E. coli
cagtattgcgctaaccgatgcgtta

SEQ ID NO: 217764 - DNA, 25 bp, E. coli
cagtattgcgcttaccgatgcgtta

SEQ ID NO: 217765 - DNA, 25 bp, E. coli
accgttgctacgcatatgtcgttga

SEQ ID NO: 217766 - DNA, 25 bp, E. coli
accgttgctacggatatgtcgttga

SEQ ID NO: 217767 - DNA, 25 bp, E. coli
tgcgttaattgatagcgggcataag

SEQ ID NO: 217768 - DNA, 25 bp, E. coli
tgcgttaattgaaagcgggcataag

SEQ ID NO: 217769 - DNA, 25 bp, E. coli
gctaagttcgcctgccgatgaatcc

SEQ ID NO: 217770 - DNA, 25 bp, E. coli
gctaagttcgccagccgatgaatcc

SEQ ID NO: 217771 - DNA, 25 bp, E. coli
gacaaatacgagttcccggtggtgg

SEQ ID NO: 217772 - DNA, 25 bp, E. coli
gacaaatacgagatcccggtggtgg

SEQ ID NO: 217773 - DNA, 25 bp, E. coli
cgtttatattaaggcctgcaccagg

SEQ ID NO: 217774 - DNA, 25 bp, E. coli
cgtttatattaacgcctgcaccagg

SEQ ID NO: 217775 - DNA, 25 bp, E. coli
gttattattccacctaattgccgga

SEQ ID NO: 217776 - DNA, 25 bp, E. coli
gataattatggcgacagtattgcgc

SEQ ID NO: 217777 - DNA, 25 bp, E. coli
gataattatggccacagtattgcgc

SEQ ID NO: 217778 - DNA, 25 bp, E. coli
gttattattccagctaattgccgga

SEQ ID NO: 217779 - DNA, 25 bp, E. coli
taagaatattgcatgcctgcatgcg

SEQ ID NO: 217780 - DNA, 25 bp, E. coli
taagaatattgcttgcctgcatgcg

SEQ ID NO: 217781 - DNA, 25 bp, E. coli
gatgaatccttctttgcacaactcg

SEQ ID NO: 217782 - DNA, 25 bp, E. coli
gatgaatccttcattgcacaactcg

SEQ ID NO: 217783 - DNA, 25 bp, E. coli
caatatacggcggtaacctgccttc

SEQ ID NO: 217784 - DNA, 25 bp, E. coli
caatatacggcgctaacctgccttc

SEQ ID NO: 217785 - DNA, 25 bp, E. coli
cagccagttaatccgcatagcgcca

SEQ ID NO: 217786 - DNA, 25 bp, E. coli
cagccagttaatgcgcatagcgcca

SEQ ID NO: 217787 - DNA, 25 bp, E. coli
catggtgctttggaaactggtgccc

SEQ ID NO: 217788 - DNA, 25 bp, E. coli
catggtgctttgcaaactggtgccc

SEQ ID NO: 217789 - DNA, 25 bp, E. coli
aaactggtgcccactcaacatcgtt

SEQ ID NO: 217790 - DNA, 25 bp, E. coli
aaactggtgccctctcaacatcgtt

SEQ ID NO: 217791 - DNA, 25 bp, E. coli
actctgttcggatagtggcggtgct

SEQ ID NO: 217792 - DNA, 25 bp, E. coli
actctgttcggaaagtggcggtgct

SEQ ID NO: 217793 - DNA, 25 bp, E. coli
tagaagaagttccactgcagccagt

SEQ ID NO: 217794 - DNA, 25 bp, E. coli
tagaagaagttcgactgcagccagt

SEQ ID NO: 217795 - DNA, 25 bp, E. coli
tgctgcaagcatagccggactctgt

SEQ ID NO: 217796 - DNA, 25 bp, E. coli
tgctgcaagcattgccggactctgt

SEQ ID NO: 217797 - DNA, 25 bp, E. coli
tgctggatcgcagcaaagagccagg

SEQ ID NO: 217798 - DNA, 25 bp, E. coli
tgctggatcgcaccaaagagccagg

SEQ ID NO: 217799 - DNA, 25 bp, E. coli
gaacccctgtacgtggatgtgatga

SEQ ID NO: 217800 - DNA, 25 bp, E. coli
gaacccctgtacctggatgtgatga

SEQ ID NO: 217801 - DNA, 25 bp, E. coli
gaactcgctgtttgaagataacgcc

SEQ ID NO: 217802 - DNA, 25 bp, E. coli
gaactcgctgttagaagataacgcc

SEQ ID NO: 217803 - DNA, 25 bp, E. coli
gattcttgaactcatgccgcaggca

SEQ ID NO: 217804 - DNA, 25 bp, E. coli
gattcttgaactgatgccgcaggca

SEQ ID NO: 217805 - DNA, 25 bp, E. coli
aatgatgggctgcactggcgataac

SEQ ID NO: 217806 - DNA, 25 bp, E. coli
aatgatgggctggactggcgataac

SEQ ID NO: 217807 - DNA, 25 bp, E. coli
catcaaagcggtatatcagggcgcg

SEQ ID NO: 217808 - DNA, 25 bp, E. coli
catcaaagcggtttatcagggcgcg

SEQ ID NO: 217809 - DNA, 25 bp, E. coli
tatgaccgtcgctgcaagtgttcag

SEQ ID NO: 217810 - DNA, 25 bp, E. coli
tatgaccgtcgcagcaagtgttcag

SEQ ID NO: 217811 - DNA, 25 bp, E. coli
tacctcaagcgtgcgaaagatggcg

SEQ ID NO: 217812 - DNA, 25 bp, E. coli
tacctcaagcgtccgaaagatggcg

SEQ ID NO: 217813 - DNA, 25 bp, E. coli
tgctcagaaggatctccggaagggt

SEQ ID NO: 217814 - DNA, 25 bp, E. coli
tgctcagaaggaactccggaagggt

SEQ ID NO: 217815 - DNA, 25 bp, E. coli
tgacctacgcggagaacaaagacgc

SEQ ID NO: 217816 - DNA, 25 bp, E. coli
tgacctacgcggtgaacaaagacgc

SEQ ID NO: 217817 - DNA, 25 bp, E. coli
tctggcggcagcaacgaatacttcg

SEQ ID NO: 217818 - DNA, 25 bp, E. coli
tctggcggcagctacgaatacttcg

SEQ ID NO: 217819 - DNA, 25 bp, E. coli
gaagatctgattcaaccggcgcgtg

SEQ ID NO: 217820 - DNA, 25 bp, E. coli
gaagatctgattgaaccggcgcgtg

SEQ ID NO: 217821 - DNA, 25 bp, E. coli
gaatacttcgaaggcatgggcttgc

SEQ ID NO: 217822 - DNA, 25 bp, E. coli
gaatacttcgaacgcatgggcttgc

SEQ ID NO: 217823 - DNA, 25 bp, E. coli
gacgtgaaagttcgccaggctctga

SEQ ID NO: 217824 - DNA, 25 bp, E. coli
gacgtgaaagttggccaggctctga

SEQ ID NO: 217825 - DNA, 25 bp, E. coli
gatcctgaaaaaccgaaagccttgc

SEQ ID NO: 217826 - DNA, 25 bp, E. coli
gatcctgaaaaagcgaaagccttgc

SEQ ID NO: 217827 - DNA, 25 bp, E. coli
cacctggtgggattggatgcatgtc

SEQ ID NO: 217828 - DNA, 25 bp, E. coli
cacctggtgggaatggatgcatgtc

SEQ ID NO: 217829 - DNA, 25 bp, E. coli
catgagttacgataaaacggtgcgc

SEQ ID NO: 217830 - DNA, 25 bp, E. coli
cagatgaactcgaaagccgatgagg

SEQ ID NO: 217831 - DNA, 25 bp, E. coli
cagatgaactcgtaagccgatgagg

SEQ ID NO: 217832 - DNA, 25 bp, E. coli
catgagttacgaaaaaacggtgcgc

SEQ ID NO: 217833 - DNA, 25 bp, E. coli
tacgccagaaggtgccagcaatgct

SEQ ID NO: 217834 - DNA, 25 bp, E. coli
tacagagctcccattccagagcggc

SEQ ID NO: 217835 - DNA, 25 bp, E. coli
tacagagctccctttccagagcggc

SEQ ID NO: 217836 - DNA, 25 bp, E. coli
tacgccagaaggagccagcaatgct

SEQ ID NO: 217837 - DNA, 25 bp, E. coli
gtttatcccggctcatcacgtcagg

SEQ ID NO: 217838 - DNA, 25 bp, E. coli
gattttatcagggaagctttcggac

SEQ ID NO: 217839 - DNA, 25 bp, E. coli
gtttatcccggcacatcacgtcagg

SEQ ID NO: 217840 - DNA, 25 bp, E. coli
gattttatcaggcaagctttcggac

SEQ ID NO: 217841 - DNA, 25 bp, E. coli
ggaggacatcaaaaccaaaaccggg

SEQ ID NO: 217842 - DNA, 25 bp, E. coli
ggaggacatcaataccaaaaccggg

SEQ ID NO: 217843 - DNA, 25 bp, E. coli
gacgactggaaagacagcactaagg

SEQ ID NO: 217844 - DNA, 25 bp, E. coli
gaccggcttttgcaactgaatatca

SEQ ID NO: 217845 - DNA, 25 bp, E. coli
gaccggcttttggaactgaatatca

SEQ ID NO: 217846 - DNA, 25 bp, E. coli
gacgaaggtctgagcctcactggag

SEQ ID NO: 217847 - DNA, 25 bp, E. coli
gacgactggaaacacagcactaagg

SEQ ID NO: 217848 - DNA, 25 bp, E. coli
gacgaaggtctgtgcctcactggag

SEQ ID NO: 217849 - DNA, 25 bp, E. coli
tacttcaccctcattggcttgcctg

SEQ ID NO: 217850 - DNA, 25 bp, E. coli
tacttcaccctctttggcttgcctg

SEQ ID NO: 217851 - DNA, 25 bp, E. coli
atcaactcgatagccaggcgctgag

SEQ ID NO: 217852 - DNA, 25 bp, E. coli
atcaactcgatacccaggcgctgag

SEQ ID NO: 217853 - DNA, 25 bp, E. coli
aaacgctgcgtcttccgttaatgcg

SEQ ID NO: 217854 - DNA, 25 bp, E. coli
aaacgctgcgtcatccgttaatgcg

SEQ ID NO: 217855 - DNA, 25 bp, E. coli
tctcgccagcgagcagcatactgtg

SEQ ID NO: 217856 - DNA, 25 bp, E. coli
tctcgccagcgaccagcatactgtg

SEQ ID NO: 217857 - DNA, 25 bp, E. coli
gcgcgacaccgccttcctgatggaa

SEQ ID NO: 217858 - DNA, 25 bp, E. coli
gcgcgacaccgcgttcctgatggaa

SEQ ID NO: 217859 - DNA, 25 bp, E. coli
gaagcgcggctggaaagctttatca

SEQ ID NO: 217860 - DNA, 25 bp, E. coli
gaaaaagatgttagatacccgccat

SEQ ID NO: 217861 - DNA, 25 bp, E. coli
gaaaaagatgtttgatacccgccat

SEQ ID NO: 217862 - DNA, 25 bp, E. coli
gaagcgcggctgcaaagctttatca

SEQ ID NO: 217863 - DNA, 25 bp, E. coli
gttttcaggatctacaacgtcagta

SEQ ID NO: 217864 - DNA, 25 bp, E. coli
gttttcaggatcaacaacgtcagta

SEQ ID NO: 217865 - DNA, 25 bp, E. coli
gataaattcgccagcggaagccagg

SEQ ID NO: 217866 - DNA, 25 bp, E. coli
gataaattcgcctgcggaagccagg

SEQ ID NO: 217867 - DNA, 25 bp, E. coli
tggacgagatcgaacaggcgaaaga

SEQ ID NO: 217868 - DNA, 25 bp, E. coli
tggacgagatcgtacaggcgaaaga

SEQ ID NO: 217869 - DNA, 25 bp, E. coli
taatgcgcgcggtatatttgctttc

SEQ ID NO: 217870 - DNA, 25 bp, E. coli
taatgcgcgcggaatatttgctttc

SEQ ID NO: 217871 - DNA, 25 bp, E. coli
caagtcgtcggtaggtattgcacaa

SEQ ID NO: 217872 - DNA, 25 bp, E. coli
caagtcgtcggttggtattgcacaa

SEQ ID NO: 217873 - DNA, 25 bp, E. coli
cacccaggctcactgcaaatttatc

SEQ ID NO: 217874 - DNA, 25 bp, E. coli
cacccaggctcagtgcaaatttatc

SEQ ID NO: 217875 - DNA, 25 bp, E. coli
aacgctcccgttgcagggcagtttg

SEQ ID NO: 217876 - DNA, 25 bp, E. coli
aacgctcccgttccagggcagtttg

SEQ ID NO: 217877 - DNA, 25 bp, E. coli
tatcctgtggctgcacttgaacgtg

SEQ ID NO: 217878 - DNA, 25 bp, E. coli
tatcctgtggctccacttgaacgtg

SEQ ID NO: 217879 - DNA, 25 bp, E. coli
tattgcacaaaagtcactcctgaag

SEQ ID NO: 217880 - DNA, 25 bp, E. coli
tattgcacaaaactcactcctgaag

SEQ ID NO: 217881 - DNA, 25 bp, E. coli
tcctgaaggctaagcggtcgagtcc

SEQ ID NO: 217882 - DNA, 25 bp, E. coli
tcctgaaggctatgcggtcgagtcc

SEQ ID NO: 217883 - DNA, 25 bp, E. coli
tgccgcttggcagggtcaagtcgtc

SEQ ID NO: 217884 - DNA, 25 bp, E. coli
tgccgcttggcacggtcaagtcgtc

SEQ ID NO: 217885 - DNA, 25 bp, E. coli
cctgagtgccacgtttggcttaggg

SEQ ID NO: 217886 - DNA, 25 bp, E. coli
cctgagtgccacctttggcttaggg

SEQ ID NO: 217887 - DNA, 25 bp, E. coli
gatcgcgtacgcaagaaatctggtg

SEQ ID NO: 217888 - DNA, 25 bp, E. coli
gatcgcgtacgctagaaatctggtg

SEQ ID NO: 217889 - DNA, 25 bp, E. coli
ggtcaaagtagccatgaagccaacg

SEQ ID NO: 217890 - DNA, 25 bp, E. coli
ggtcaaagtagcgatgaagccaacg

SEQ ID NO: 217891 - DNA, 25 bp, E. coli
ggcagtttgcgcatcccctgagtgc

SEQ ID NO: 217892 - DNA, 25 bp, E. coli
ggcagtttgcgcttcccctgagtgc

SEQ ID NO: 217893 - DNA, 25 bp, E. coli
atgttcacgcggcataatctcccgc

SEQ ID NO: 217894 - DNA, 25 bp, E. coli
atgttcacgcgggataatctcccgc

SEQ ID NO: 217895 - DNA, 25 bp, E. coli
tattgagcagttaaatattacttac

SEQ ID NO: 217896 - DNA, 25 bp, E. coli
tattgagcagtttaatattacttac

SEQ ID NO: 217897 - DNA, 25 bp, E. coli
tccgagtattcccaggaataatctt

SEQ ID NO: 217898 - DNA, 25 bp, E. coli
tccgagtattccgaggaataatctt

SEQ ID NO: 217899 - DNA, 25 bp, E. coli
gccacggaacccgtggcaaagaata

SEQ ID NO: 217900 - DNA, 25 bp, E. coli
cctgaaaggttagatgtattgagca

SEQ ID NO: 217901 - DNA, 25 bp, E. coli
cctgaaaggttacatgtattgagca

SEQ ID NO: 217902 - DNA, 25 bp, E. coli
gccacggaacccctggcaaagaata

SEQ ID NO: 217903 - DNA, 25 bp, E. coli
gaataatcttcatgttcacgcggca

SEQ ID NO: 217904 - DNA, 25 bp, E. coli
gaataatcttcaagttcacgcggca

SEQ ID NO: 217905 - DNA, 25 bp, E. coli
ccgaagactcctcaaaggttagatg

SEQ ID NO: 217906 - DNA, 25 bp, E. coli
ccgaagactcctgaaaggttagatg

SEQ ID NO: 217907 - DNA, 25 bp, E. coli
ggatgagttggccaaaccgaagact

SEQ ID NO: 217908 - DNA, 25 bp, E. coli
tggccaaaccgatgactcctgaaag

SEQ ID NO: 217909 - DNA, 25 bp, E. coli
tggccaaaccgaagactcctgaaag

SEQ ID NO: 217910 - DNA, 25 bp, E. coli
ggatgagttggcgaaaccgaagact

SEQ ID NO: 217911 - DNA, 25 bp, E. coli
taatcttcatgtacacgcggcataa

SEQ ID NO: 217912 - DNA, 25 bp, E. coli
taatcttcatgttcacgcggcataa

SEQ ID NO: 217913 - DNA, 25 bp, E. coli
ttacaaatttccgagtattcccagg

SEQ ID NO: 217914 - DNA, 25 bp, E. coli
ttacaaatttcccagtattcccagg

SEQ ID NO: 217915 - DNA, 25 bp, E. coli
caacgctgccgggaaaatattcatc

SEQ ID NO: 217916 - DNA, 25 bp, E. coli
caacgctgccggcaaaatattcatc

SEQ ID NO: 217917 - DNA, 25 bp, E. coli
catattggctcctgttccggctgcg

SEQ ID NO: 217918 - DNA, 25 bp, E. coli
catattggctccagttccggctgcg

SEQ ID NO: 217919 - DNA, 25 bp, E. coli
acagttgtcggtaggcactcactca

SEQ ID NO: 217920 - DNA, 25 bp, E. coli
acagttgtcggttggcactcactca

SEQ ID NO: 217921 - DNA, 25 bp, E. coli
ttatttatgacaaccctgggaacgc

SEQ ID NO: 217922 - DNA, 25 bp, E. coli
tttgtgaagagtacgacaatgcgcc

SEQ ID NO: 217923 - DNA, 25 bp, E. coli
ttatttatgacatccctgggaacgc

SEQ ID NO: 217924 - DNA, 25 bp, E. coli
tttgtgaagagttcgacaatgcgcc

SEQ ID NO: 217925 - DNA, 25 bp, E. coli
tccggctgcgacatgctgtatggca

SEQ ID NO: 217926 - DNA, 25 bp, E. coli
tccggctgcgacttgctgtatggca

SEQ ID NO: 217927 - DNA, 25 bp, E. coli
gccgatggttgtgcgctgagccaaa

SEQ ID NO: 217928 - DNA, 25 bp, E. coli
gccgatggttgtccgctgagccaaa

SEQ ID NO: 217929 - DNA, 25 bp, E. coli
gaacaggtctttgccagagcggtaa

SEQ ID NO: 217930 - DNA, 25 bp, E. coli
gaaaccctgttttattatcgcggcg

SEQ ID NO: 217931 - DNA, 25 bp, E. coli
gaacaggtctttcccagagcggtaa

SEQ ID NO: 217932 - DNA, 25 bp, E. coli
gaaaccctgtttaattatcgcggcg

SEQ ID NO: 217933 - DNA, 25 bp, E. coli
tgggaacgcaacacaggcaatagaa

SEQ ID NO: 217934 - DNA, 25 bp, E. coli
tggaagccgcattacaacaacgctg

SEQ ID NO: 217935 - DNA, 25 bp, E. coli
tggaagccgcataacaacaacgctg

SEQ ID NO: 217936 - DNA, 25 bp, E. coli
tgggaacgcaactcaggcaatagaa

SEQ ID NO: 217937 - DNA, 25 bp, E. coli
caggctgtgcgaacaacaatggtcc

SEQ ID NO: 217938 - DNA, 25 bp, E. coli
caggctgtgcgatcaacaatggtcc

SEQ ID NO: 217939 - DNA, 25 bp, E. coli
taacagattgtcagatatgcaggca

SEQ ID NO: 217940 - DNA, 25 bp, E. coli
taacagattgtctgatatgcaggca

SEQ ID NO: 217941 - DNA, 25 bp, E. coli
tatgcaggcaactatggaacaaacc

SEQ ID NO: 217942 - DNA, 25 bp, E. coli
tatgctgtagaagcgttactcgacg

SEQ ID NO: 217943 - DNA, 25 bp, E. coli
tatgctgtagaaccgttactcgacg

SEQ ID NO: 217944 - DNA, 25 bp, E. coli
tatgcaggcaacaatggaacaaacc

SEQ ID NO: 217945 - DNA, 25 bp, E. coli
tgcgaagctttcagatcaccgccgt

SEQ ID NO: 217946 - DNA, 25 bp, E. coli
tgcgaagctttctgatcaccgccgt

SEQ ID NO: 217947 - DNA, 25 bp, E. coli
tctgaatgctgggaaaaccgtgcga

SEQ ID NO: 217948 - DNA, 25 bp, E. coli
tctggtgcttcaggtattccgcaaa

SEQ ID NO: 217949 - DNA, 25 bp, E. coli
tctgaatgctggcaaaaccgtgcga

SEQ ID NO: 217950 - DNA, 25 bp, E. coli
tctggtgcttcacgtattccgcaaa

SEQ ID NO: 217951 - DNA, 25 bp, E. coli
ccgaggcggtaattcttctggtgct

SEQ ID NO: 217952 - DNA, 25 bp, E. coli
gcaaagacgatttcgcggtgaagta

SEQ ID NO: 217953 - DNA, 25 bp, E. coli
gcaaagacgattacgcggtgaagta

SEQ ID NO: 217954 - DNA, 25 bp, E. coli
gaaaaccgtgtggttgagcgtctga

SEQ ID NO: 217955 - DNA, 25 bp, E. coli
gaaaaccgtgtgcttgagcgtctga

SEQ ID NO: 217956 - DNA, 25 bp, E. coli
ccgaggcggtaaatcttctggtgct

SEQ ID NO: 217957 - DNA, 25 bp, E. coli
cattaaccgccaggaatacgaagat

SEQ ID NO: 217958 - DNA, 25 bp, E. coli
cattaaccgccacgaatacgaagat

SEQ ID NO: 217959 - DNA, 25 bp, E. coli
caagccggtgttacatcgctttttt

SEQ ID NO: 217960 - DNA, 25 bp, E. coli
caagccggtgtttcatcgctttttt

SEQ ID NO: 217961 - DNA, 25 bp, E. coli
cttttcaagccgctgttacatcgct

SEQ ID NO: 217962 - DNA, 25 bp, E. coli
cttttcaagccggtgttacatcgct

SEQ ID NO: 217963 - DNA, 25 bp, E. coli
aaaaagccagccagttgccagactg

SEQ ID NO: 217964 - DNA, 25 bp, E. coli
aaaaagccagcctgttgccagactg

SEQ ID NO: 217965 - DNA, 25 bp, E. coli
tatcaccctccgtttaaggcgttaa

SEQ ID NO: 217966 - DNA, 25 bp, E. coli
tatcaccctccgattaaggcgttaa

SEQ ID NO: 217967 - DNA, 25 bp, E. coli
tatcatcaggatgtatgtgaacgct

SEQ ID NO: 217968 - DNA, 25 bp, E. coli
tatcatcaggatctatgtgaacgct

SEQ ID NO: 217969 - DNA, 25 bp, E. coli
tcaggacgggtctatacgcgtaaaa

SEQ ID NO: 217970 - DNA, 25 bp, E. coli
tctatgtgaacgcttttcaggacgg

SEQ ID NO: 217971 - DNA, 25 bp, E. coli
tcaggacgggtcaatacgcgtaaaa

SEQ ID NO: 217972 - DNA, 25 bp, E. coli
tctatgtgaacggttttcaggacgg

SEQ ID NO: 217973 - DNA, 25 bp, E. coli
ccagactggcttatgtgcttttcaa

SEQ ID NO: 217974 - DNA, 25 bp, E. coli
ccagactggcttttgtgcttttcaa

SEQ ID NO: 217975 - DNA, 25 bp, E. coli
gcttttgtgcttttcaagccggtgt

SEQ ID NO: 217976 - DNA, 25 bp, E. coli
gcttttgtgcttatcaagccggtgt

SEQ ID NO: 217977 - DNA, 25 bp, E. coli
gaacgcttttcaggacgggtcaata

SEQ ID NO: 217978 - DNA, 25 bp, E. coli
gaacgcttttcacgacgggtcaata

SEQ ID NO: 217979 - DNA, 25 bp, E. coli
taagtcattgccttatcaccctccg

SEQ ID NO: 217980 - DNA, 25 bp, E. coli
taagtcattgccatatcaccctccg

SEQ ID NO: 217981 - DNA, 25 bp, E. coli
tactcaacgatgaacgcgtgctcga

SEQ ID NO: 217982 - DNA, 25 bp, E. coli
tactcaacgatgtacgcgtgctcga

SEQ ID NO: 217983 - DNA, 25 bp, E. coli
taccactatgcgcagctggcaaagc

SEQ ID NO: 217984 - DNA, 25 bp, E. coli
taccactatgcggagctggcaaagc

SEQ ID NO: 217985 - DNA, 25 bp, E. coli
tgacgctgcggagggttatcaccag

SEQ ID NO: 217986 - DNA, 25 bp, E. coli
tgaaaatactggagatcggcccgtc

SEQ ID NO: 217987 - DNA, 25 bp, E. coli
tgctcgataaagaagcctggccgct

SEQ ID NO: 217988 - DNA, 25 bp, E. coli
tgacgctgcggacggttatcaccag

SEQ ID NO: 217989 - DNA, 25 bp, E. coli
tgaaaatactggtgatcggcccgtc

SEQ ID NO: 217990 - DNA, 25 bp, E. coli
tgctcgataaagtagcctggccgct

SEQ ID NO: 217991 - DNA, 25 bp, E. coli
tcacggagcgctggaaatcggcgaa

SEQ ID NO: 217992 - DNA, 25 bp, E. coli
tcacggagcgctcgaaatcggcgaa

SEQ ID NO: 217993 - DNA, 25 bp, E. coli
gcgaacgccgcaaactgggtcatag

SEQ ID NO: 217994 - DNA, 25 bp, E. coli
gcgaacgccgcatactgggtcatag

SEQ ID NO: 217995 - DNA, 25 bp, E. coli
gattaccggctatcacaaagtgcgt

SEQ ID NO: 217996 - DNA, 25 bp, E. coli
gtttggtccggctaaacgctggcca

SEQ ID NO: 217997 - DNA, 25 bp, E. coli
gattaccggctaacacaaagtgcgt

SEQ ID NO: 217998 - DNA, 25 bp, E. coli
gtttggtccggcaaaacgctggcca

SEQ ID NO: 217999 - DNA, 25 bp, E. coli
ggcgagatgcgctacggtttactca

SEQ ID NO: 218000 - DNA, 25 bp, E. coli
ggcgagatgcgcaacggtttactca

SEQ ID NO: 218001 - DNA, 25 bp, E. coli
gatgatgtcgcatagtctctatcgc

SEQ ID NO: 218002 - DNA, 25 bp, E. coli
gatgatgtcgcaaagtctctatcgc

SEQ ID NO: 218003 - DNA, 25 bp, E. coli
aatttaaacagcaccatcatcacca

SEQ ID NO: 218004 - DNA, 25 bp, E. coli
aatttaaacagctccatcatcacca

SEQ ID NO: 218005 - DNA, 25 bp, E. coli
cacgcgttcaatttaaacagcacca

SEQ ID NO: 218006 - DNA, 25 bp, E. coli
cacgcgttcaatataaacagcacca

SEQ ID NO: 218007 - DNA, 25 bp, E. coli
taaacagcaccatcatcaccatcat

SEQ ID NO: 218008 - DNA, 25 bp, E. coli
taaacagcaccaacatcaccatcat

SEQ ID NO: 218009 - DNA, 25 bp, E. coli
agcaccatcatcaccatcatcctga

SEQ ID NO: 218010 - DNA, 25 bp, E. coli
atgacacgcgttgaatttaaacagc

SEQ ID NO: 218011 - DNA, 25 bp, E. coli
atgacacgcgttcaatttaaacagc

SEQ ID NO: 218012 - DNA, 25 bp, E. coli
agcaccatcatctccatcatcctga

SEQ ID NO: 218013 - DNA, 25 bp, E. coli
tttaaacagcacgatcatcaccatc

SEQ ID NO: 218014 - DNA, 25 bp, E. coli
tttaaacagcaccatcatcaccatc

SEQ ID NO: 218015 - DNA, 25 bp, E. coli
gcgttcaatttaaacagcaccatca

SEQ ID NO: 218016 - DNA, 25 bp, E. coli
gcgttcaatttatacagcaccatca

SEQ ID NO: 218017 - DNA, 25 bp, E. coli
gacacgcgttcaatttaaacagcac

SEQ ID NO: 218018 - DNA, 25 bp, E. coli
gacacgcgttcattttaaacagcac

SEQ ID NO: 218019 - DNA, 25 bp, E. coli
cgcgttcaattttaacagcaccatc

SEQ ID NO: 218020 - DNA, 25 bp, E. coli
cgcgttcaatttaaacagcaccatc

SEQ ID NO: 218021 - DNA, 25 bp, E. coli
gttcaatttaaacagcaccatcatc

SEQ ID NO: 218022 - DNA, 25 bp, E. coli
gttcaatttaaagagcaccatcatc

SEQ ID NO: 218023 - DNA, 25 bp, E. coli
tcaatttaaacagcaccatcatcac

SEQ ID NO: 218024 - DNA, 25 bp, E. coli
tcaatttaaacaccaccatcatcac

SEQ ID NO: 218025 - DNA, 25 bp, E. coli
caggtaataaagatgattgccgcca

SEQ ID NO: 218026 - DNA, 25 bp, E. coli
caggtaataaagttgattgccgcca

SEQ ID NO: 218027 - DNA, 25 bp, E. coli
tatgtgacgggctaagatacccttc

SEQ ID NO: 218028 - DNA, 25 bp, E. coli
tatcggttcggcagtcaatcgcttc

SEQ ID NO: 218029 - DNA, 25 bp, E. coli
tatcggttcggctgtcaatcgcttc

SEQ ID NO: 218030 - DNA, 25 bp, E. coli
tatgtgacgggcaaagatacccttc

SEQ ID NO: 218031 - DNA, 25 bp, E. coli
tataacgttgactcctctgacagaa

SEQ ID NO: 218032 - DNA, 25 bp, E. coli
tataacgttgacacctctgacagaa

SEQ ID NO: 218033 - DNA, 25 bp, E. coli
tctgatgaagtgtgagcgtagcgtc

SEQ ID NO: 218034 - DNA, 25 bp, E. coli
tctgatgaagtgagagcgtagcgtc

SEQ ID NO: 218035 - DNA, 25 bp, E. coli
gcgtccacgacatcaacaggtatgt

SEQ ID NO: 218036 - DNA, 25 bp, E. coli
gcgtccacgacaacaacaggtatgt

SEQ ID NO: 218037 - DNA, 25 bp, E. coli
gaatcaatgacatcacccgtgactg

SEQ ID NO: 218038 - DNA, 25 bp, E. coli
gaaccggttacggaagaggatgtac

SEQ ID NO: 218039 - DNA, 25 bp, E. coli
gcagcgcgaaacatttacctcagag

SEQ ID NO: 218040 - DNA, 25 bp, E. coli
gaaccggttacgcaagaggatgtac

SEQ ID NO: 218041 - DNA, 25 bp, E. coli
gaatcaatgacaacacccgtgactg

SEQ ID NO: 218042 - DNA, 25 bp, E. coli
gcagcgcgaaacttttacctcagag

SEQ ID NO: 218043 - DNA, 25 bp, E. coli
gatacactttattcaacgcagcgcg

SEQ ID NO: 218044 - DNA, 25 bp, E. coli
gatacactttatacaacgcagcgcg

SEQ ID NO: 218045 - DNA, 25 bp, E. coli
gagtatcctgacacctctgatgaag

SEQ ID NO: 218046 - DNA, 25 bp, E. coli
gagtatcctgactcctctgatgaag

SEQ ID NO: 218047 - DNA, 25 bp, E. coli
tactgttcctgagggcccgaagtga

SEQ ID NO: 218048 - DNA, 25 bp, E. coli
tactgttcctgacggcccgaagtga

SEQ ID NO: 218049 - DNA, 25 bp, E. coli
tggtcccgccaggaactgatggata

SEQ ID NO: 218050 - DNA, 25 bp, E. coli
tggtcccgccagcaactgatggata

SEQ ID NO: 218051 - DNA, 25 bp, E. coli
tcgaggtctttgtgcgaggcttgcc

SEQ ID NO: 218052 - DNA, 25 bp, E. coli
tcgaggtctttgagcgaggcttgcc

SEQ ID NO: 218053 - DNA, 25 bp, E. coli
gctttgaattgtgccgccagttact

SEQ ID NO: 218054 - DNA, 25 bp, E. coli
gctttgaattgtcccgccagttact

SEQ ID NO: 218055 - DNA, 25 bp, E. coli
gcagatcagctgctttgacacgcca

SEQ ID NO: 218056 - DNA, 25 bp, E. coli
gcagatcagctggtttgacacgcca

SEQ ID NO: 218057 - DNA, 25 bp, E. coli
cccgaagtgaagtggtcgatcgcct

SEQ ID NO: 218058 - DNA, 25 bp, E. coli
cccgaagtgaagaggtcgatcgcct

SEQ ID NO: 218059 - DNA, 25 bp, E. coli
gattaatactcaacgcggcatggga

SEQ ID NO: 218060 - DNA, 25 bp, E. coli
gatacccacatttaaacgctgcgtg

SEQ ID NO: 218061 - DNA, 25 bp, E. coli
gattaatactcatcgcggcatggga

SEQ ID NO: 218062 - DNA, 25 bp, E. coli
gatacccacattaaaacgctgcgtg

SEQ ID NO: 218063 - DNA, 25 bp, E. coli
gttactggcgctccatccggcgtta

SEQ ID NO: 218064 - DNA, 25 bp, E. coli
gttactggcgctgcatccggcgtta

SEQ ID NO: 218065 - DNA, 25 bp, E. coli
gtgaagaagttctcgacgccgtctc

SEQ ID NO: 218066 - DNA, 25 bp, E. coli
gtgaagaagttcacgacgccgtctc

SEQ ID NO: 218067 - DNA, 25 bp, E. coli
ggaagatgcgcaggacacctacgat

SEQ ID NO: 218068 - DNA, 25 bp, E. coli
ggaagatgcgcacgacacctacgat

SEQ ID NO: 218069 - DNA, 25 bp, E. coli
atgccattgtctggaaaaagaacgc

SEQ ID NO: 218070 - DNA, 25 bp, E. coli
attgtctcgaaatagaacgcgccgg

SEQ ID NO: 218071 - DNA, 25 bp, E. coli
attgtctcgaaaaagaacgcgccgg

SEQ ID NO: 218072 - DNA, 25 bp, E. coli
atgccattgtctcgaaaaagaacgc

SEQ ID NO: 218073 - DNA, 25 bp, E. coli
ttgtctcgaaaatgaacgcgccggg

SEQ ID NO: 218074 - DNA, 25 bp, E. coli
ttgtctcgaaaaagaacgcgccggg

SEQ ID NO: 218075 - DNA, 25 bp, E. coli
tgtctcgaaaaacaacgcgccggga

SEQ ID NO: 218076 - DNA, 25 bp, E. coli
tgtctcgaaaaagaacgcgccggga

SEQ ID NO: 218077 - DNA, 25 bp, E. coli
tgccattgtctccaaaaagaacgcg

SEQ ID NO: 218078 - DNA, 25 bp, E. coli
tgccattgtctcgaaaaagaacgcg

SEQ ID NO: 218079 - DNA, 25 bp, E. coli
ccattgtctcgaaaaagaacgcgcc

SEQ ID NO: 218080 - DNA, 25 bp, E. coli
ccattgtctcgataaagaacgcgcc

SEQ ID NO: 218081 - DNA, 25 bp, E. coli
gccattgtctcgaaaaagaacgcgc

SEQ ID NO: 218082 - DNA, 25 bp, E. coli
gccattgtctcgtaaaagaacgcgc

SEQ ID NO: 218083 - DNA, 25 bp, E. coli
cattgtctcgaaaaagaacgcgccg

SEQ ID NO: 218084 - DNA, 25 bp, E. coli
cggatgccattgtctcgaaaaagaa

SEQ ID NO: 218085 - DNA, 25 bp, E. coli
cattgtctcgaataagaacgcgccg

SEQ ID NO: 218086 - DNA, 25 bp, E. coli
cggatgccattgactcgaaaaagaa

SEQ ID NO: 218087 - DNA, 25 bp, E. coli
ggatgccattgtctcgaaaaagaac

SEQ ID NO: 218088 - DNA, 25 bp, E. coli
ggatgccattgtgtcgaaaaagaac

SEQ ID NO: 218089 - DNA, 25 bp, E. coli
gatgccattgtcacgaaaaagaacg

SEQ ID NO: 218090 - DNA, 25 bp, E. coli
gatgccattgtctcgaaaaagaacg

SEQ ID NO: 218091 - DNA, 25 bp, E. coli
catagccactctcaaacgcgtgaag

SEQ ID NO: 218092 - DNA, 25 bp, E. coli
cataacatagccactctgaaacgcg

SEQ ID NO: 218093 - DNA, 25 bp, E. coli
catagccactctgaaacgcgtgaag

SEQ ID NO: 218094 - DNA, 25 bp, E. coli
cataacatagcctctctgaaacgcg

SEQ ID NO: 218095 - DNA, 25 bp, E. coli
taacatagccacactgaaacgcgtg

SEQ ID NO: 218096 - DNA, 25 bp, E. coli
agccactctgaatcgcgtgaagaat

SEQ ID NO: 218097 - DNA, 25 bp, E. coli
agccactctgaaacgcgtgaagaat

SEQ ID NO: 218098 - DNA, 25 bp, E. coli
actgtcgcataagatagccactctg

SEQ ID NO: 218099 - DNA, 25 bp, E. coli
aacatagccactgtgaaacgcgtga

SEQ ID NO: 218100 - DNA, 25 bp, E. coli
aacatagccactctgaaacgcgtga

SEQ ID NO: 218101 - DNA, 25 bp, E. coli
actgtcgcataacatagccactctg

SEQ ID NO: 218102 - DNA, 25 bp, E. coli
tagccactctgatacgcgtgaagaa

SEQ ID NO: 218103 - DNA, 25 bp, E. coli
tagccactctgaaacgcgtgaagaa

SEQ ID NO: 218104 - DNA, 25 bp, E. coli
tgtcgcataacatagccactctgaa

SEQ ID NO: 218105 - DNA, 25 bp, E. coli
tgtcgcataacaaagccactctgaa

SEQ ID NO: 218106 - DNA, 25 bp, E. coli
tcgcataacatagccactctgaaac

SEQ ID NO: 218107 - DNA, 25 bp, E. coli
tcgcataacatacccactctgaaac

SEQ ID NO: 218108 - DNA, 25 bp, E. coli
gaaactgtcgcataacatagccact

SEQ ID NO: 218109 - DNA, 25 bp, E. coli
gaaactgtcgcaaaacatagccact

SEQ ID NO: 218110 - DNA, 25 bp, E. coli
tggaaactgtcggataacatagcca

SEQ ID NO: 218111 - DNA, 25 bp, E. coli
tggaaactgtcgcataacatagcca

SEQ ID NO: 218112 - DNA, 25 bp, E. coli
taacatagccactctgaaacgcgtg

SEQ ID NO: 218113 - DNA, 25 bp, E. coli
catagttgtcgttatcaggcatacc

SEQ ID NO: 218114 - DNA, 25 bp, E. coli
catagttgtcgtaatcaggcatacc

SEQ ID NO: 218115 - DNA, 25 bp, E. coli
taggtcatcggcctttgatcgggat

SEQ ID NO: 218116 - DNA, 25 bp, E. coli
taggtcatcggcgtttgatcgggat

SEQ ID NO: 218117 - DNA, 25 bp, E. coli
ttcgccgcctgacctaaatattttc

SEQ ID NO: 218118 - DNA, 25 bp, E. coli
ttcgccgcctgagctaaatattttc

SEQ ID NO: 218119 - DNA, 25 bp, E. coli
tgccgctcacggtaaaactcttcgt

SEQ ID NO: 218120 - DNA, 25 bp, E. coli
tgccgctcacggaaaaactcttcgt

SEQ ID NO: 218121 - DNA, 25 bp, E. coli
gcgtcctgccgctcacggaaaaact

SEQ ID NO: 218122 - DNA, 25 bp, E. coli
gcgtcctgccgcacacggaaaaact

SEQ ID NO: 218123 - DNA, 25 bp, E. coli
gaaaaactcttcctaggtcatcggc

SEQ ID NO: 218124 - DNA, 25 bp, E. coli
gaaaaactcttcgtaggtcatcggc

SEQ ID NO: 218125 - DNA, 25 bp, E. coli
ccgcatatgttcgacatagttgtcg

SEQ ID NO: 218126 - DNA, 25 bp, E. coli
ccgcatatgttccacatagttgtcg

SEQ ID NO: 218127 - DNA, 25 bp, E. coli
tgacctaaatattttccggcttttg

SEQ ID NO: 218128 - DNA, 25 bp, E. coli
tgacctaaatatattccggcttttg

SEQ ID NO: 218129 - DNA, 25 bp, E. coli
gtttgatcgggaaggttaacccgca

SEQ ID NO: 218130 - DNA, 25 bp, E. coli
gtttgatcgggatggttaacccgca

SEQ ID NO: 218131 - DNA, 25 bp, E. coli
ggttaacccgcatatgttcgacata

SEQ ID NO: 218132 - DNA, 25 bp, E. coli
gtcgtaatcagggataccaatcatc

SEQ ID NO: 218133 - DNA, 25 bp, E. coli
ggttaacccgcaaatgttcgacata

SEQ ID NO: 218134 - DNA, 25 bp, E. coli
gtcgtaatcaggcataccaatcatc

SEQ ID NO: 218135 - DNA, 25 bp, E. coli
taaaaacagtattacttcaggcaga

SEQ ID NO: 218136 - DNA, 25 bp, E. coli
taaaaacagtataacttcaggcaga

SEQ ID NO: 218137 - DNA, 25 bp, E. coli
tgctggcaagaacagactactgtat

SEQ ID NO: 218138 - DNA, 25 bp, E. coli
tgctggcaagaagagactactgtat

SEQ ID NO: 218139 - DNA, 25 bp, E. coli
tcagcagcctatgcagcgacaaata

SEQ ID NO: 218140 - DNA, 25 bp, E. coli
ccacgtgagcacaagataagagaac

SEQ ID NO: 218141 - DNA, 25 bp, E. coli
ccacgtgagcactagataagagaac

SEQ ID NO: 218142 - DNA, 25 bp, E. coli
gcttctattctaatttttagccggg

SEQ ID NO: 218143 - DNA, 25 bp, E. coli
gcttctattctattttttagccggg

SEQ ID NO: 218144 - DNA, 25 bp, E. coli
gcgacaaatattcatagcctgaatc

SEQ ID NO: 218145 - DNA, 25 bp, E. coli
gcgacaaatattgatagcctgaatc

SEQ ID NO: 218146 - DNA, 25 bp, E. coli
gaatcagtattgatctgctggcaag

SEQ ID NO: 218147 - DNA, 25 bp, E. coli
gaatcagtattgttctgctggcaag

SEQ ID NO: 218148 - DNA, 25 bp, E. coli
cgggcgggatgcgtcaatgtcttta

SEQ ID NO: 218149 - DNA, 25 bp, E. coli
cgggcgggatgcctcaatgtcttta

SEQ ID NO: 218150 - DNA, 25 bp, E. coli
gtcgtcgccagaaggccacgtgagc

SEQ ID NO: 218151 - DNA, 25 bp, E. coli
gtcgtcgccagatggccacgtgagc

SEQ ID NO: 218152 - DNA, 25 bp, E. coli
taattcatagtttgccgggcgggat

SEQ ID NO: 218153 - DNA, 25 bp, E. coli
taattcatagttagccgggcgggat

SEQ ID NO: 218154 - DNA, 25 bp, E. coli
taagagaacgaaaaatcagcagcct

SEQ ID NO: 218155 - DNA, 25 bp, E. coli
tcagcagcctatccagcgacaaata

SEQ ID NO: 218156 - DNA, 25 bp, E. coli
taagagaacgaataatcagcagcct

SEQ ID NO: 218157 - DNA, 25 bp, E. coli
taaatatcagctcaatccgcagggt

SEQ ID NO: 218158 - DNA, 25 bp, E. coli
taaatatcagctgaatccgcagggt

SEQ ID NO: 218159 - DNA, 25 bp, E. coli
acgacgcggcgtcgaacagcttcgt

SEQ ID NO: 218160 - DNA, 25 bp, E. coli
acgacgcggcgtggaacagcttcgt

SEQ ID NO: 218161 - DNA, 25 bp, E. coli
ttttagcgtttagcgcatcggcggc

SEQ ID NO: 218162 - DNA, 25 bp, E. coli
ttaaaggtgaagagtacgacgcggc

SEQ ID NO: 218163 - DNA, 25 bp, E. coli
ttttagcgtttaccgcatcggcggc

SEQ ID NO: 218164 - DNA, 25 bp, E. coli
ttaaaggtgaagtgtacgacgcggc

SEQ ID NO: 218165 - DNA, 25 bp, E. coli
tggtcgctcagctggaaaaagctgc

SEQ ID NO: 218166 - DNA, 25 bp, E. coli
tggtcgctcagcaggaaaaagctgc

SEQ ID NO: 218167 - DNA, 25 bp, E. coli
tgccggaaggcgtgaagatgactaa

SEQ ID NO: 218168 - DNA, 25 bp, E. coli
tgcccgcactgcaatcagtttgaag

SEQ ID NO: 218169 - DNA, 25 bp, E. coli
tgccggaaggcgagaagatgactaa

SEQ ID NO: 218170 - DNA, 25 bp, E. coli
tgcccgcactgctatcagtttgaag

SEQ ID NO: 218171 - DNA, 25 bp, E. coli
gcggcgcagtatgaagatggtaaac

SEQ ID NO: 218172 - DNA, 25 bp, E. coli
gcttcgtggtgaaatctctggtcgc

SEQ ID NO: 218173 - DNA, 25 bp, E. coli
gcttcgtggtgatatctctggtcgc

SEQ ID NO: 218174 - DNA, 25 bp, E. coli
gcggcgcagtatcaagatggtaaac

SEQ ID NO: 218175 - DNA, 25 bp, E. coli
gaaaaagctgcacctgacgtgcaat

SEQ ID NO: 218176 - DNA, 25 bp, E. coli
gaaaaagctgcagctgacgtgcaat

SEQ ID NO: 218177 - DNA, 25 bp, E. coli
gatggtaaacagaacactaccctgg

SEQ ID NO: 218178 - DNA, 25 bp, E. coli
gatggtaaacagtacactaccctgg

SEQ ID NO: 218179 - DNA, 25 bp, E. coli
caattcgataaacaagcacagagcg

SEQ ID NO: 218180 - DNA, 25 bp, E. coli
aagcacagagcgtcggcataagcct

SEQ ID NO: 218181 - DNA, 25 bp, E. coli
caattcgataaagaagcacagagcg

SEQ ID NO: 218182 - DNA, 25 bp, E. coli
aagcacagagcgacggcataagcct

SEQ ID NO: 218183 - DNA, 25 bp, E. coli
cagagcgacggcttaagcctagcca

SEQ ID NO: 218184 - DNA, 25 bp, E. coli
cagagcgacggcataagcctagcca

SEQ ID NO: 218185 - DNA, 25 bp, E. coli
tactgaactaaaccggcgcggtata

SEQ ID NO: 218186 - DNA, 25 bp, E. coli
tactgaactaaagcggcgcggtata

SEQ ID NO: 218187 - DNA, 25 bp, E. coli
tagccaactggcataaagagttggg

SEQ ID NO: 218188 - DNA, 25 bp, E. coli
tagccaactggcttaaagagttggg

SEQ ID NO: 218189 - DNA, 25 bp, E. coli
tgcgaatttctcgagagctaaaaga

SEQ ID NO: 218190 - DNA, 25 bp, E. coli
tgcgaatttctccagagctaaaaga

SEQ ID NO: 218191 - DNA, 25 bp, E. coli
ccagagctaaaacagcaattcgata

SEQ ID NO: 218192 - DNA, 25 bp, E. coli
ccagagctaaaagagcaattcgata

SEQ ID NO: 218193 - DNA, 25 bp, E. coli
gcgcggtatagatcccaaaggataa

SEQ ID NO: 218194 - DNA, 25 bp, E. coli
gcgcggtatagaacccaaaggataa

SEQ ID NO: 218195 - DNA, 25 bp, E. coli
gacggcataagcctagccaactggc

SEQ ID NO: 218196 - DNA, 25 bp, E. coli
cgtactgaactaaagcggcgcggta

SEQ ID NO: 218197 - DNA, 25 bp, E. coli
cgtactgaactatagcggcgcggta

SEQ ID NO: 218198 - DNA, 25 bp, E. coli
gataaagaagcacagagcgacggca

SEQ ID NO: 218199 - DNA, 25 bp, E. coli
gataaagaagcagagagcgacggca

SEQ ID NO: 218200 - DNA, 25 bp, E. coli
gacggcataagcgtagccaactggc

SEQ ID NO: 218201 - DNA, 25 bp, E. coli
aatgcaactatctgaaaaaacctag

SEQ ID NO: 218202 - DNA, 25 bp, E. coli
aataggccccagatagacactgaga

SEQ ID NO: 218203 - DNA, 25 bp, E. coli
aataggccccagttagacactgaga

SEQ ID NO: 218204 - DNA, 25 bp, E. coli
aatgcaactatcagaaaaaacctag

SEQ ID NO: 218205 - DNA, 25 bp, E. coli
cagccgttcttgtttttacgcataa

SEQ ID NO: 218206 - DNA, 25 bp, E. coli
cagccgttcttgattttacgcataa

SEQ ID NO: 218207 - DNA, 25 bp, E. coli
cagacacaccttttgcaagaacgtg

SEQ ID NO: 218208 - DNA, 25 bp, E. coli
catatatgggactgaaataggcccc

SEQ ID NO: 218209 - DNA, 25 bp, E. coli
catatatgggacagaaataggcccc

SEQ ID NO: 218210 - DNA, 25 bp, E. coli
cagacacaccttatgcaagaacgtg

SEQ ID NO: 218211 - DNA, 25 bp, E. coli
gccaaggaaaccacaggatgggaaa

SEQ ID NO: 218212 - DNA, 25 bp, E. coli
gccaaggaaacctcaggatgggaaa

SEQ ID NO: 218213 - DNA, 25 bp, E. coli
tagaaaacgccatggaaaccacagg

SEQ ID NO: 218214 - DNA, 25 bp, E. coli
tagaaaacgccaaggaaaccacagg

SEQ ID NO: 218215 - DNA, 25 bp, E. coli
tgaaaaaccgcagacacaccttatg

SEQ ID NO: 218216 - DNA, 25 bp, E. coli
tgaaaaaccgcacacacaccttatg

SEQ ID NO: 218217 - DNA, 25 bp, E. coli
gacactgagatcgaacttaggatgc

SEQ ID NO: 218218 - DNA, 25 bp, E. coli
gaacgtgctgcgattggctggtaaa

SEQ ID NO: 218219 - DNA, 25 bp, E. coli
gaacgtgctgcgtttggctggtaaa

SEQ ID NO: 218220 - DNA, 25 bp, E. coli
gacactgagatccaacttaggatgc

SEQ ID NO: 218221 - DNA, 25 bp, E. coli
ggatgggaaaaaacacctgtgaatt

SEQ ID NO: 218222 - DNA, 25 bp, E. coli
ggatgggaaaaatcacctgtgaatt

SEQ ID NO: 218223 - DNA, 25 bp, E. coli
ttgacggcgaacaggcggatttgac

SEQ ID NO: 218224 - DNA, 25 bp, E. coli
ttgacggcgaactggcggatttgac

SEQ ID NO: 218225 - DNA, 25 bp, E. coli
tgaaatgtaaacctctgaatgaagt

SEQ ID NO: 218226 - DNA, 25 bp, E. coli
tgaaatgtaaacgtctgaatgaagt

SEQ ID NO: 218227 - DNA, 25 bp, E. coli
gcaaaaagagcctgaccttaacctg

SEQ ID NO: 218228 - DNA, 25 bp, E. coli
gaagttattgaagtcctccagccag

SEQ ID NO: 218229 - DNA, 25 bp, E. coli
gaagttattgaactcctccagccag

SEQ ID NO: 218230 - DNA, 25 bp, E. coli
gcaatttttgcacaaactggcgaaa

SEQ ID NO: 218231 - DNA, 25 bp, E. coli
gcaaaaagagccagaccttaacctg

SEQ ID NO: 218232 - DNA, 25 bp, E. coli
gcaatttttgcagaaactggcgaaa

SEQ ID NO: 218233 - DNA, 25 bp, E. coli
cgaaagagtcaggttttgacggcga

SEQ ID NO: 218234 - DNA, 25 bp, E. coli
cgaaagagtcagcttttgacggcga

SEQ ID NO: 218235 - DNA, 25 bp, E. coli
ctggcggatttgtcggatgacattc

SEQ ID NO: 218236 - DNA, 25 bp, E. coli
cggtgatcccggctttgcagaaaga

SEQ ID NO: 218237 - DNA, 25 bp, E. coli
cggtgatcccgggtttgcagaaaga

SEQ ID NO: 218238 - DNA, 25 bp, E. coli
ctggcggatttgacggatgacattc

SEQ ID NO: 218239 - DNA, 25 bp, E. coli
gattccgcgaaacatgcggtgatcc

SEQ ID NO: 218240 - DNA, 25 bp, E. coli
gattccgcgaaagatgcggtgatcc

SEQ ID NO: 218241 - DNA, 25 bp, E. coli
tcacctgaaaatccgtgattccgcg

SEQ ID NO: 218242 - DNA, 25 bp, E. coli
tcacctgaaaatgcgtgattccgcg

SEQ ID NO: 218243 - DNA, 25 bp, E. coli
gatgacattctgatctatcacctga

SEQ ID NO: 218244 - DNA, 25 bp, E. coli
gatgacattctgttctatcacctga

SEQ ID NO: 218245 - DNA, 25 bp, E. coli
aattttttgcaattagtgctaatgc

SEQ ID NO: 218246 - DNA, 25 bp, E. coli
aattttttgcaaatagtgctaatgc

SEQ ID NO: 218247 - DNA, 25 bp, E. coli
catttaactgacaatctatacaaga

SEQ ID NO: 218248 - DNA, 25 bp, E. coli
catttaactgactatctatacaaga

SEQ ID NO: 218249 - DNA, 25 bp, E. coli
aacatattgcatgatttaactgaca

SEQ ID NO: 218250 - DNA, 25 bp, E. coli
aacatattgcatcatttaactgaca

SEQ ID NO: 218251 - DNA, 25 bp, E. coli
tagcaaacttgtacgaaatatgtgt

SEQ ID NO: 218252 - DNA, 25 bp, E. coli
tagcaaacttgttcgaaatatgtgt

SEQ ID NO: 218253 - DNA, 25 bp, E. coli
tatacaagatttatcgccaactagt

SEQ ID NO: 218254 - DNA, 25 bp, E. coli
ttatcaatgtaaagaaacggttatg

SEQ ID NO: 218255 - DNA, 25 bp, E. coli
tatacaagatttttcgccaactagt

SEQ ID NO: 218256 - DNA, 25 bp, E. coli
ttatcaatgtaatgaaacggttatg

SEQ ID NO: 218257 - DNA, 25 bp, E. coli
gccaactagtgtacaactttttcca

SEQ ID NO: 218258 - DNA, 25 bp, E. coli
gccaactagtgttcaactttttcca

SEQ ID NO: 218259 - DNA, 25 bp, E. coli
gctacgcctctgataaaaatgttaa

SEQ ID NO: 218260 - DNA, 25 bp, E. coli
gctacgcctctgttaaaaatgttaa

SEQ ID NO: 218261 - DNA, 25 bp, E. coli
gaagtaacaatagcaaacttgtacg

SEQ ID NO: 218262 - DNA, 25 bp, E. coli
gaagtaacaataccaaacttgtacg

SEQ ID NO: 218263 - DNA, 25 bp, E. coli
cgaaatatgtgtacagaatgataaa

SEQ ID NO: 218264 - DNA, 25 bp, E. coli
cgaaatatgtgttcagaatgataaa

SEQ ID NO: 218265 - DNA, 25 bp, E. coli
gtgctaatgcatataaaacaatgtg

SEQ ID NO: 218266 - DNA, 25 bp, E. coli
gtgctaatgcatttaaaacaatgtg

SEQ ID NO: 218267 - DNA, 25 bp, E. coli
cattatgatgcgtagccagcaggct

SEQ ID NO: 218268 - DNA, 25 bp, E. coli
cattatgatgcgaagccagcaggct

SEQ ID NO: 218269 - DNA, 25 bp, E. coli
tactggtggccttaagcgttcggtt

SEQ ID NO: 218270 - DNA, 25 bp, E. coli
tactggtggcctaaagcgttcggtt

SEQ ID NO: 218271 - DNA, 25 bp, E. coli
acttctttacgatgggtgcgggcgc

SEQ ID NO: 218272 - DNA, 25 bp, E. coli
acttctttacgaagggtgcgggcgc

SEQ ID NO: 218273 - DNA, 25 bp, E. coli
tacctgtggaaacagtggctgacct

SEQ ID NO: 218274 - DNA, 25 bp, E. coli
taccattctgaagatgcgcgcaccg

SEQ ID NO: 218275 - DNA, 25 bp, E. coli
taccattctgaacatgcgcgcaccg

SEQ ID NO: 218276 - DNA, 25 bp, E. coli
tacctgtggaaagagtggctgacct

SEQ ID NO: 218277 - DNA, 25 bp, E. coli
tttgagccagcagattgacccgcag

SEQ ID NO: 218278 - DNA, 25 bp, E. coli
ttccataacgtgttcatcggcggcg

SEQ ID NO: 218279 - DNA, 25 bp, E. coli
tttgagccagcacattgacccgcag

SEQ ID NO: 218280 - DNA, 25 bp, E. coli
ttcaccatgtatcagggccgcatcg

SEQ ID NO: 218281 - DNA, 25 bp, E. coli
ttcaccatgtatgagggccgcatcg

SEQ ID NO: 218282 - DNA, 25 bp, E. coli
ttccataacgtgatcatcggcggcg

SEQ ID NO: 218283 - DNA, 25 bp, E. coli
tgccggtggcagtaatcgaaaaact

SEQ ID NO: 218284 - DNA, 25 bp, E. coli
tgccggtggcagaaatcgaaaaact

SEQ ID NO: 218285 - DNA, 25 bp, E. coli
cgtacgctggagagggcaacctctt

SEQ ID NO: 218286 - DNA, 25 bp, E. coli
cgtacgctggagtgggcaacctctt

SEQ ID NO: 218287 - DNA, 25 bp, E. coli
taacgtttctctcggcgtgggcgaa

SEQ ID NO: 218288 - DNA, 25 bp, E. coli
taacgtttctctgggcgtgggcgaa

SEQ ID NO: 218289 - DNA, 25 bp, E. coli
caaaaaggtggttctgcttattgca

SEQ ID NO: 218290 - DNA, 25 bp, E. coli
caaaaaggtggtactgcttattgca

SEQ ID NO: 218291 - DNA, 25 bp, E. coli
cacgcattattgtaaatcgcagccc

SEQ ID NO: 218292 - DNA, 25 bp, E. coli
cacgcattattgaaaatcgcagccc

SEQ ID NO: 218293 - DNA, 25 bp, E. coli
ttagataagtgtaaagacccatttc

SEQ ID NO: 218294 - DNA, 25 bp, E. coli
ttagataagtgttaagacccatttc

SEQ ID NO: 218295 - DNA, 25 bp, E. coli
tgttttgtgtgaactgcatcacgca

SEQ ID NO: 218296 - DNA, 25 bp, E. coli
tgttttgtgtgatctgcatcacgca

SEQ ID NO: 218297 - DNA, 25 bp, E. coli
gcggtgaaaccgcataaaaataaag

SEQ ID NO: 218298 - DNA, 25 bp, E. coli
gcggtgaaaccggataaaaataaag

SEQ ID NO: 218299 - DNA, 25 bp, E. coli
gcagcttatcgcaactattctaatg

SEQ ID NO: 218300 - DNA, 25 bp, E. coli
gcagcttatcgctactattctaatg

SEQ ID NO: 218301 - DNA, 25 bp, E. coli
gacccatttctatttgtaaggacat

SEQ ID NO: 218302 - DNA, 25 bp, E. coli
cccctccgttgtttgtgcgtgtagt

SEQ ID NO: 218303 - DNA, 25 bp, E. coli
cccctccgttgtatgtgcgtgtagt

SEQ ID NO: 218304 - DNA, 25 bp, E. coli
cgtgtagtgacgagtacagttgcgt

SEQ ID NO: 218305 - DNA, 25 bp, E. coli
cgtgtagtgacgtgtacagttgcgt

SEQ ID NO: 218306 - DNA, 25 bp, E. coli
ggagtcattaccgatttatgttaag

SEQ ID NO: 218307 - DNA, 25 bp, E. coli
ggagtcattacccatttatgttaag

SEQ ID NO: 218308 - DNA, 25 bp, E. coli
tacagttgcgtccatttaggaaaaa

SEQ ID NO: 218309 - DNA, 25 bp, E. coli
tacagttgcgtcgatttaggaaaaa

SEQ ID NO: 218310 - DNA, 25 bp, E. coli
gacccatttctaattgtaaggacat

SEQ ID NO: 218311 - DNA, 25 bp, E. coli
caatcatggcaatttagtacgtgca

SEQ ID NO: 218312 - DNA, 25 bp, E. coli
caatcatggcaaattagtacgtgca

SEQ ID NO: 218313 - DNA, 25 bp, E. coli
catcaaatatcgtggtaaaggccta

SEQ ID NO: 218314 - DNA, 25 bp, E. coli
catcaaatatcgaggtaaaggccta

SEQ ID NO: 218315 - DNA, 25 bp, E. coli
tactatagatacagtagccgttgct

SEQ ID NO: 218316 - DNA, 25 bp, E. coli
tactccacaggaagctactaacata

SEQ ID NO: 218317 - DNA, 25 bp, E. coli
tactccacaggatgctactaacata

SEQ ID NO: 218318 - DNA, 25 bp, E. coli
tactatagatactgtagccgttgct

SEQ ID NO: 218319 - DNA, 25 bp, E. coli
acttcaaaatattgaggttcacctg

SEQ ID NO: 218320 - DNA, 25 bp, E. coli
acttcaaaatatagaggttcacctg

SEQ ID NO: 218321 - DNA, 25 bp, E. coli
tctcaatgaggatgaaataaaacgc

SEQ ID NO: 218322 - DNA, 25 bp, E. coli
tctcaatgaggaagaaataaaacgc

SEQ ID NO: 218323 - DNA, 25 bp, E. coli
tctcactgcgaggttggtgtcgata

SEQ ID NO: 218324 - DNA, 25 bp, E. coli
tctcactgcgagcttggtgtcgata

SEQ ID NO: 218325 - DNA, 25 bp, E. coli
gctaattcattcctcaaatgggcag

SEQ ID NO: 218326 - DNA, 25 bp, E. coli
gctaattcattcgtcaaatgggcag

SEQ ID NO: 218327 - DNA, 25 bp, E. coli
ggaaaatgtggaggctcaaagaagc

SEQ ID NO: 218328 - DNA, 25 bp, E. coli
ggaaaatgtggacgctcaaagaagc

SEQ ID NO: 218329 - DNA, 25 bp, E. coli
taagccgtatcctgctcaaaacagc

SEQ ID NO: 218330 - DNA, 25 bp, E. coli
taagccgtatccagctcaaaacagc

SEQ ID NO: 218331 - DNA, 25 bp, E. coli
gagctatttcctatgcagtcccaac

SEQ ID NO: 218332 - DNA, 25 bp, E. coli
gagctatttcctttgcagtcccaac

SEQ ID NO: 218333 - DNA, 25 bp, E. coli
caggaacgtgtgaatagtgcgccaa

SEQ ID NO: 218334 - DNA, 25 bp, E. coli
caggaacgtgtgtatagtgcgccaa

SEQ ID NO: 218335 - DNA, 25 bp, E. coli
cattccttaactagagcctttcggc

SEQ ID NO: 218336 - DNA, 25 bp, E. coli
cattccttaacttgagcctttcggc

SEQ ID NO: 218337 - DNA, 25 bp, E. coli
cgacttcgtactaaattggagagac

SEQ ID NO: 218338 - DNA, 25 bp, E. coli
agtgcgccaagttatcagtattaag

SEQ ID NO: 218339 - DNA, 25 bp, E. coli
cgacttcgtacttaattggagagac

SEQ ID NO: 218340 - DNA, 25 bp, E. coli
agtgcgccaagtaatcagtattaag

SEQ ID NO: 218341 - DNA, 25 bp, E. coli
tatagctttcttgaggaacgtgtgt

SEQ ID NO: 218342 - DNA, 25 bp, E. coli
tatagctttcttcaggaacgtgtgt

SEQ ID NO: 218343 - DNA, 25 bp, E. coli
tattttagacatgcagccatcttca

SEQ ID NO: 218344 - DNA, 25 bp, E. coli
tattttagacatccagccatcttca

SEQ ID NO: 218345 - DNA, 25 bp, E. coli
tctgttcttcaaaccgacgcaatca

SEQ ID NO: 218346 - DNA, 25 bp, E. coli
tctgttcttcaatccgacgcaatca

SEQ ID NO: 218347 - DNA, 25 bp, E. coli
gcctttcggcattaatggtttgcat

SEQ ID NO: 218348 - DNA, 25 bp, E. coli
gcctttcggcataaatggtttgcat

SEQ ID NO: 218349 - DNA, 25 bp, E. coli
gaataacacctgtaatgagaactgc

SEQ ID NO: 218350 - DNA, 25 bp, E. coli
gaataacacctgaaatgagaactgc

SEQ ID NO: 218351 - DNA, 25 bp, E. coli
ggtttgcataacagaaacgacttcg

SEQ ID NO: 218352 - DNA, 25 bp, E. coli
ggtttgcataactgaaacgacttcg

SEQ ID NO: 218353 - DNA, 25 bp, E. coli
gacgcaatcatttacgcatagttga

SEQ ID NO: 218354 - DNA, 25 bp, E. coli
gacgcaatcattaacgcatagttga

SEQ ID NO: 218355 - DNA, 25 bp, E. coli
aagcggcgagtaatcttgctgatac

SEQ ID NO: 218356 - DNA, 25 bp, E. coli
aagcggcgagtattcttgctgatac

SEQ ID NO: 218357 - DNA, 25 bp, E. coli
aaaagcgcatttatcttcaaggcag

SEQ ID NO: 218358 - DNA, 25 bp, E. coli
aaaagcgcatttttcttcaaggcag

SEQ ID NO: 218359 - DNA, 25 bp, E. coli
tatggatatactgggagatgataac

SEQ ID NO: 218360 - DNA, 25 bp, E. coli
tatggatatactcggagatgataac

SEQ ID NO: 218361 - DNA, 25 bp, E. coli
tatcttcaaggctgagttatctctg

SEQ ID NO: 218362 - DNA, 25 bp, E. coli
tatctctgccttcagtttttcatcc

SEQ ID NO: 218363 - DNA, 25 bp, E. coli
tatctctgccttgagtttttcatcc

SEQ ID NO: 218364 - DNA, 25 bp, E. coli
tatcttcaaggcagagttatctctg

SEQ ID NO: 218365 - DNA, 25 bp, E. coli
ttcatccctctcttccacgttgtgg

SEQ ID NO: 218366 - DNA, 25 bp, E. coli
ttcatccctctcatccacgttgtgg

SEQ ID NO: 218367 - DNA, 25 bp, E. coli
tgtaaacgaaaagtgcgccgaagcg

SEQ ID NO: 218368 - DNA, 25 bp, E. coli
tgtaaacgaaaactgcgccgaagcg

SEQ ID NO: 218369 - DNA, 25 bp, E. coli
ccacgttgtggtaaagcggcgagta

SEQ ID NO: 218370 - DNA, 25 bp, E. coli
ccacgttgtggttaagcggcgagta

SEQ ID NO: 218371 - DNA, 25 bp, E. coli
gaattttccctttcaacatcctgta

SEQ ID NO: 218372 - DNA, 25 bp, E. coli
gaattttcccttacaacatcctgta

SEQ ID NO: 218373 - DNA, 25 bp, E. coli
cgccgaagcgcactttaatcgttga

SEQ ID NO: 218374 - DNA, 25 bp, E. coli
cgccgaagcgcagtttaatcgttga

SEQ ID NO: 218375 - DNA, 25 bp, E. coli
gatactcctcatagctatttccacc

SEQ ID NO: 218376 - DNA, 25 bp, E. coli
gatactcctcattgctatttccacc

SEQ ID NO: 218377 - DNA, 25 bp, E. coli
cacgtaatcacgatattcggggact

SEQ ID NO: 218378 - DNA, 25 bp, E. coli
cacgtaatcacgttattcggggact

SEQ ID NO: 218379 - DNA, 25 bp, E. coli
atcgcacgtaatgacgttattcggg

SEQ ID NO: 218380 - DNA, 25 bp, E. coli
atcgcacgtaatcacgttattcggg

SEQ ID NO: 218381 - DNA, 25 bp, E. coli
tatctgcgggattttacccttcagg

SEQ ID NO: 218382 - DNA, 25 bp, E. coli
tatctgcgggatattacccttcagg

SEQ ID NO: 218383 - DNA, 25 bp, E. coli
ttttcatcttgcgaggatcgcacgt

SEQ ID NO: 218384 - DNA, 25 bp, E. coli
ttttcatcttgccaggatcgcacgt

SEQ ID NO: 218385 - DNA, 25 bp, E. coli
tgccaggatcgcacgtaatcacgtt

SEQ ID NO: 218386 - DNA, 25 bp, E. coli
tgccaggatcgctcgtaatcacgtt

SEQ ID NO: 218387 - DNA, 25 bp, E. coli
tcttgccaggatcgcacgtaatcac

SEQ ID NO: 218388 - DNA, 25 bp, E. coli
tcttgccaggatggcacgtaatcac

SEQ ID NO: 218389 - DNA, 25 bp, E. coli
tcatcttgccaggatcgcacgtaat

SEQ ID NO: 218390 - DNA, 25 bp, E. coli
tcatcttgccagcatcgcacgtaat

SEQ ID NO: 218391 - DNA, 25 bp, E. coli
ccaggatcgcacctaatcacgttat

SEQ ID NO: 218392 - DNA, 25 bp, E. coli
ccaggatcgcacgtaatcacgttat

SEQ ID NO: 218393 - DNA, 25 bp, E. coli
ctgcgggatattacccttcaggtaa

SEQ ID NO: 218394 - DNA, 25 bp, E. coli
ctgcgggatatttcccttcaggtaa

SEQ ID NO: 218395 - DNA, 25 bp, E. coli
ggatcgcacgtattcacgttattcg

SEQ ID NO: 218396 - DNA, 25 bp, E. coli
ggatcgcacgtaatcacgttattcg

SEQ ID NO: 218397 - DNA, 25 bp, E. coli
gggactttatctgcgggatattacc

SEQ ID NO: 218398 - DNA, 25 bp, E. coli
gggactttatctccgggatattacc

SEQ ID NO: 218399 - DNA, 25 bp, E. coli
aacctgtgccagtggtagttactca

SEQ ID NO: 218400 - DNA, 25 bp, E. coli
caactactcgaagtggagttagcag

SEQ ID NO: 218401 - DNA, 25 bp, E. coli
caactactcgaactggagttagcag

SEQ ID NO: 218402 - DNA, 25 bp, E. coli
ctaacgtaggagatgaggtaacacc

SEQ ID NO: 218403 - DNA, 25 bp, E. coli
agggcatgccatcttcgacgtacta

SEQ ID NO: 218404 - DNA, 25 bp, E. coli
agggcatgccatgttcgacgtacta

SEQ ID NO: 218405 - DNA, 25 bp, E. coli
ctaacgtaggagttgaggtaacacc

SEQ ID NO: 218406 - DNA, 25 bp, E. coli
aacctgtgccagaggtagttactca

SEQ ID NO: 218407 - DNA, 25 bp, E. coli
tagcaggatggaacgcagctgtacc

SEQ ID NO: 218408 - DNA, 25 bp, E. coli
tatgtccgattgtggagggcatgcc

SEQ ID NO: 218409 - DNA, 25 bp, E. coli
tagcaggatggatcgcagctgtacc

SEQ ID NO: 218410 - DNA, 25 bp, E. coli
tatgtccgattgaggagggcatgcc

SEQ ID NO: 218411 - DNA, 25 bp, E. coli
tgtacccggcggctatgtccgattg

SEQ ID NO: 218412 - DNA, 25 bp, E. coli
tgtacccggcgggtatgtccgattg

SEQ ID NO: 218413 - DNA, 25 bp, E. coli
gcattgccatttgctgagctcctgg

SEQ ID NO: 218414 - DNA, 25 bp, E. coli
gcattgccatttcctgagctcctgg

SEQ ID NO: 218415 - DNA, 25 bp, E. coli
gcaatttggattccactggttgcca

SEQ ID NO: 218416 - DNA, 25 bp, E. coli
gcaatttggattgcactggttgcca

SEQ ID NO: 218417 - DNA, 25 bp, E. coli
cggaagaaattcaggaaaacttgca

SEQ ID NO: 218418 - DNA, 25 bp, E. coli
cggaagaaattctggaaaacttgca

SEQ ID NO: 218419 - DNA, 25 bp, E. coli
ggtaacacctgtagacgtcgtcgct

SEQ ID NO: 218420 - DNA, 25 bp, E. coli
ggtaacacctgttgacgtcgtcgct

SEQ ID NO: 218421 - DNA, 25 bp, E. coli
cacacaattaccaggcgatcgcgaa

SEQ ID NO: 218422 - DNA, 25 bp, E. coli
caccggaagttaaagcggcagccag

SEQ ID NO: 218423 - DNA, 25 bp, E. coli
cacacaattacctggcgatcgcgaa

SEQ ID NO: 218424 - DNA, 25 bp, E. coli
caccggaagttatagcggcagccag

SEQ ID NO: 218425 - DNA, 25 bp, E. coli
tacaatatgcgcgaaattcctcccg

SEQ ID NO: 218426 - DNA, 25 bp, E. coli
tacaatatgcgccaaattcctcccg

SEQ ID NO: 218427 - DNA, 25 bp, E. coli
tattcaacgtctcgaaccgaaagcg

SEQ ID NO: 218428 - DNA, 25 bp, E. coli
tattaaattgttgtggcgaccggct

SEQ ID NO: 218429 - DNA, 25 bp, E. coli
tattaaattgttctggcgaccggct

SEQ ID NO: 218430 - DNA, 25 bp, E. coli
tattcaacgtctggaaccgaaagcg

SEQ ID NO: 218431 - DNA, 25 bp, E. coli
tgcagttacaggtcagccagcaggg

SEQ ID NO: 218432 - DNA, 25 bp, E. coli
tgcagttacaggacagccagcaggg

SEQ ID NO: 218433 - DNA, 25 bp, E. coli
tccggataaaaggagcgaccatgcg

SEQ ID NO: 218434 - DNA, 25 bp, E. coli
tccggataaaagcagcgaccatgcg

SEQ ID NO: 218435 - DNA, 25 bp, E. coli
gcctgcgtatcgtaaaccaaagtga

SEQ ID NO: 218436 - DNA, 25 bp, E. coli
gcctgcgtatcgaaaaccaaagtga

SEQ ID NO: 218437 - DNA, 25 bp, E. coli
gaaaaaggcgttctcccaggcttca

SEQ ID NO: 218438 - DNA, 25 bp, E. coli
gaaaaaggcgttgtcccaggcttca

SEQ ID NO: 218439 - DNA, 25 bp, E. coli
cgaccggctgcaatacgcaagaaag

SEQ ID NO: 218440 - DNA, 25 bp, E. coli
cgaccggctgcattacgcaagaaag

SEQ ID NO: 218441 - DNA, 25 bp, E. coli
gattacggcgcattacgcatgacga

SEQ ID NO: 218442 - DNA, 25 bp, E. coli
gattacggcgcaatacgcatgacga

SEQ ID NO: 218443 - DNA, 25 bp, E. coli
cacaaacagtcggatggtggcagga

SEQ ID NO: 218444 - DNA, 25 bp, E. coli
cacaaacagtcgcatggtggcagga

SEQ ID NO: 218445 - DNA, 25 bp, E. coli
tcctcagggagatagtcgtcaacta

SEQ ID NO: 218446 - DNA, 25 bp, E. coli
tcctcagggagaaagtcgtcaacta

SEQ ID NO: 218447 - DNA, 25 bp, E. coli
tctgaatacaacctcccggaacgct

SEQ ID NO: 218448 - DNA, 25 bp, E. coli
tctgaatacaacgtcccggaacgct

SEQ ID NO: 218449 - DNA, 25 bp, E. coli
gacaacgacgagtatggttacccga

SEQ ID NO: 218450 - DNA, 25 bp, E. coli
gacaacgacgagaatggttacccga

SEQ ID NO: 218451 - DNA, 25 bp, E. coli
cgcgctgtcatgcttttggcaaaga

SEQ ID NO: 218452 - DNA, 25 bp, E. coli
cgcgctgtcatggttttggcaaaga

SEQ ID NO: 218453 - DNA, 25 bp, E. coli
cattattagtacctgcaggtgcagg

SEQ ID NO: 218454 - DNA, 25 bp, E. coli
cattattagtacgtgcaggtgcagg

SEQ ID NO: 218455 - DNA, 25 bp, E. coli
ggtacagcggttccacgatgcacta

SEQ ID NO: 218456 - DNA, 25 bp, E. coli
ggttacccgacatcaaaacaggatg

SEQ ID NO: 218457 - DNA, 25 bp, E. coli
ggttacccgacaacaaaacaggatg

SEQ ID NO: 218458 - DNA, 25 bp, E. coli
ggtacagcggttgcacgatgcacta

SEQ ID NO: 218459 - DNA, 25 bp, E. coli
tggataacaatccacgcgccactgg

SEQ ID NO: 218460 - DNA, 25 bp, E. coli
tggataacaatcgacgcgccactgg

SEQ ID NO: 218461 - DNA, 25 bp, E. coli
taatgcagggattcaccttgccgct

SEQ ID NO: 218462 - DNA, 25 bp, E. coli
taatgcagggatacaccttgccgct

SEQ ID NO: 218463 - DNA, 25 bp, E. coli
gatgtatccggatgtaacacccgcg

SEQ ID NO: 218464 - DNA, 25 bp, E. coli
gatgtatccggaagtaacacccgcg

SEQ ID NO: 218465 - DNA, 25 bp, E. coli
taactacatccaatagccacagcgc

SEQ ID NO: 218466 - DNA, 25 bp, E. coli
catgcattgtcaagttaccttttaa

SEQ ID NO: 218467 - DNA, 25 bp, E. coli
catgcattgtcatgttaccttttaa

SEQ ID NO: 218468 - DNA, 25 bp, E. coli
tagccacagcgcgatcctgtgcgaa

SEQ ID NO: 218469 - DNA, 25 bp, E. coli
tagccacagcgccatcctgtgcgaa

SEQ ID NO: 218470 - DNA, 25 bp, E. coli
tttgtttctatgaccttcttgcccc

SEQ ID NO: 218471 - DNA, 25 bp, E. coli
tttgtttctatgtccttcttgcccc

SEQ ID NO: 218472 - DNA, 25 bp, E. coli
cctgtgcgaaatattgtgatcttcc

SEQ ID NO: 218473 - DNA, 25 bp, E. coli
cctgtgcgaaattttgtgatcttcc

SEQ ID NO: 218474 - DNA, 25 bp, E. coli
gatcttcctccacattacataacat

SEQ ID NO: 218475 - DNA, 25 bp, E. coli
gacagaaatcggctaacaccggttt

SEQ ID NO: 218476 - DNA, 25 bp, E. coli
gatcttcctccagattacataacat

SEQ ID NO: 218477 - DNA, 25 bp, E. coli
gacagaaatcgggtaacaccggttt

SEQ ID NO: 218478 - DNA, 25 bp, E. coli
cctctggattttccgagggcgtatt

SEQ ID NO: 218479 - DNA, 25 bp, E. coli
cctctggattttgcgagggcgtatt

SEQ ID NO: 218480 - DNA, 25 bp, E. coli
cgagggcgtatttgtttctatgtcc

SEQ ID NO: 218481 - DNA, 25 bp, E. coli
cgagggcgtattagtttctatgtcc

SEQ ID NO: 218482 - DNA, 25 bp, E. coli
gtttaattgccccacgccctctgga

SEQ ID NO: 218483 - DNA, 25 bp, E. coli
gtttaattgcccgacgccctctgga

SEQ ID NO: 218484 - DNA, 25 bp, E. coli
gtctctgacagaaatcggctaacac

SEQ ID NO: 218485 - DNA, 25 bp, E. coli
gtctctgacagatatcggctaacac

SEQ ID NO: 218486 - DNA, 25 bp, E. coli
taactacatccattagccacagcgc

SEQ ID NO: 218487 - DNA, 25 bp, E. coli
aagatagcggatttttctgaagaga

SEQ ID NO: 218488 - DNA, 25 bp, E. coli
aagatagcggatatttctgaagaga

SEQ ID NO: 218489 - DNA, 25 bp, E. coli
catgatttgtcaataaagatagcgg

SEQ ID NO: 218490 - DNA, 25 bp, E. coli
catgatttgtcattaaagatagcgg

SEQ ID NO: 218491 - DNA, 25 bp, E. coli
taacagatgattaaatgagtatggc

SEQ ID NO: 218492 - DNA, 25 bp, E. coli
taacagatgatttaatgagtatggc

SEQ ID NO: 218493 - DNA, 25 bp, E. coli
aatgaagagaaaaccgttaatccag

SEQ ID NO: 218494 - DNA, 25 bp, E. coli
aatgaagagaaatccgttaatccag

SEQ ID NO: 218495 - DNA, 25 bp, E. coli
taccactgcaaccattagttcctga

SEQ ID NO: 218496 - DNA, 25 bp, E. coli
taccactgcaacgattagttcctga

SEQ ID NO: 218497 - DNA, 25 bp, E. coli
ccaaaatagagattaatgtagacct

SEQ ID NO: 218498 - DNA, 25 bp, E. coli
ccaaaatagagaataatgtagacct

SEQ ID NO: 218499 - DNA, 25 bp, E. coli
gaagccacgaaatattaataatagc

SEQ ID NO: 218500 - DNA, 25 bp, E. coli
gaagccacgaaaaattaataatagc

SEQ ID NO: 218501 - DNA, 25 bp, E. coli
taattcagcaagcaatattatctgc

SEQ ID NO: 218502 - DNA, 25 bp, E. coli
tcactactatatgcacagacgttct

SEQ ID NO: 218503 - DNA, 25 bp, E. coli
tcactactatatccacagacgttct

SEQ ID NO: 218504 - DNA, 25 bp, E. coli
taataatagcctaccactgcaacca

SEQ ID NO: 218505 - DNA, 25 bp, E. coli
taattcagcaaggaatattatctgc

SEQ ID NO: 218506 - DNA, 25 bp, E. coli
taataatagccttccactgcaacca

SEQ ID NO: 218507 - DNA, 25 bp, E. coli
gagtatggctgtaaatgaactcata

SEQ ID NO: 218508 - DNA, 25 bp, E. coli
gagtatggctgttaatgaactcata

SEQ ID NO: 218509 - DNA, 25 bp, E. coli
cacatgacattatcgggcgggaagc

SEQ ID NO: 218510 - DNA, 25 bp, E. coli
cacatgacattaacgggcgggaagc

SEQ ID NO: 218511 - DNA, 25 bp, E. coli
aacacagcatttcctcgcggcgggc

SEQ ID NO: 218512 - DNA, 25 bp, E. coli
aacacagcatttgctcgcggcgggc

SEQ ID NO: 218513 - DNA, 25 bp, E. coli
tatcccgcaggaagtcgccgtaatg

SEQ ID NO: 218514 - DNA, 25 bp, E. coli
tatcccgcaggatgtcgccgtaatg

SEQ ID NO: 218515 - DNA, 25 bp, E. coli
tttttctgaagaagacgctgcccgc

SEQ ID NO: 218516 - DNA, 25 bp, E. coli
tttttctgaagatgacgctgcccgc

SEQ ID NO: 218517 - DNA, 25 bp, E. coli
taagatgcgcgctcaaggacgtaag

SEQ ID NO: 218518 - DNA, 25 bp, E. coli
tctggctaccggtaagtgcgttggc

SEQ ID NO: 218519 - DNA, 25 bp, E. coli
tctggctaccggaaagtgcgttggc

SEQ ID NO: 218520 - DNA, 25 bp, E. coli
cattaaaggatgtcgcacgcctggc

SEQ ID NO: 218521 - DNA, 25 bp, E. coli
cattaaaggatgacgcacgcctggc

SEQ ID NO: 218522 - DNA, 25 bp, E. coli
gatatgtggtaaggatcgcgcagcc

SEQ ID NO: 218523 - DNA, 25 bp, E. coli
gatatgtggtaacgatcgcgcagcc

SEQ ID NO: 218524 - DNA, 25 bp, E. coli
gataatctggttggcgtcgggcatc

SEQ ID NO: 218525 - DNA, 25 bp, E. coli
gataatctggttcgcgtcgggcatc

SEQ ID NO: 218526 - DNA, 25 bp, E. coli
gtctcccgggtgttgcataatgcag

SEQ ID NO: 218527 - DNA, 25 bp, E. coli
gtctcccgggtgatgcataatgcag

SEQ ID NO: 218528 - DNA, 25 bp, E. coli
taagatgcgcgcacaaggacgtaag

SEQ ID NO: 218529 - DNA, 25 bp, E. coli
gaccacttcaaatcgggcaaaccag

SEQ ID NO: 218530 - DNA, 25 bp, E. coli
gaccacttcaaaacgggcaaaccag

SEQ ID NO: 218531 - DNA, 25 bp, E. coli
cacgggcggccagtttgaatgccaa

SEQ ID NO: 218532 - DNA, 25 bp, E. coli
cacgggcggccactttgaatgccaa

SEQ ID NO: 218533 - DNA, 25 bp, E. coli
catatcttcgcggaggatcacggct

SEQ ID NO: 218534 - DNA, 25 bp, E. coli
catatcttcgcgcaggatcacggct

SEQ ID NO: 218535 - DNA, 25 bp, E. coli
ttagcctgcaggtcgtcaacggtca

SEQ ID NO: 218536 - DNA, 25 bp, E. coli
ttagcctgcaggacgtcaacggtca

SEQ ID NO: 218537 - DNA, 25 bp, E. coli
tcttcataacgtgcggcttcaaggg

SEQ ID NO: 218538 - DNA, 25 bp, E. coli
tcggcgagatcttccagcgtacaaa

SEQ ID NO: 218539 - DNA, 25 bp, E. coli
tcggcgagatctaccagcgtacaaa

SEQ ID NO: 218540 - DNA, 25 bp, E. coli
tcttcataacgtccggcttcaaggg

SEQ ID NO: 218541 - DNA, 25 bp, E. coli
gcttcaacggcgttatccatggtgt

SEQ ID NO: 218542 - DNA, 25 bp, E. coli
gcgttgttgccctgatccagagaga

SEQ ID NO: 218543 - DNA, 25 bp, E. coli
gcgttgttgcccagatccagagaga

SEQ ID NO: 218544 - DNA, 25 bp, E. coli
gcttcaacggcgatatccatggtgt

SEQ ID NO: 218545 - DNA, 25 bp, E. coli
gaaccagcaaatattacgggcagcc

SEQ ID NO: 218546 - DNA, 25 bp, E. coli
gaaccagcaaattttacgggcagcc

SEQ ID NO: 218547 - DNA, 25 bp, E. coli
gaacagttcgatcagcatttccggc

SEQ ID NO: 218548 - DNA, 25 bp, E. coli
gaacagttcgatgagcatttccggc

SEQ ID NO: 218549 - DNA, 25 bp, E. coli
cggaagttttcacgcggcagcatat

SEQ ID NO: 218550 - DNA, 25 bp, E. coli
cggaagttttcaggcggcagcatat

SEQ ID NO: 218551 - DNA, 25 bp, E. coli
ggtcaacccttccatatcagccaga

SEQ ID NO: 218552 - DNA, 25 bp, E. coli
ggtcaacccttcgatatcagccaga

SEQ ID NO: 218553 - DNA, 25 bp, E. coli
caatttcgacactgaggttataacc

SEQ ID NO: 218554 - DNA, 25 bp, E. coli
caatacaatgagttacagatgcatc

SEQ ID NO: 218555 - DNA, 25 bp, E. coli
caatttcgacacagaggttataacc

SEQ ID NO: 218556 - DNA, 25 bp, E. coli
caatacaatgagatacagatgcatc

SEQ ID NO: 218557 - DNA, 25 bp, E. coli
caactataaagtcaaagagccgtca

SEQ ID NO: 218558 - DNA, 25 bp, E. coli
caactataaagtgaaagagccgtca

SEQ ID NO: 218559 - DNA, 25 bp, E. coli
taaatcgactgctttcttagacgcg

SEQ ID NO: 218560 - DNA, 25 bp, E. coli
taaatcgactgcattcttagacgcg

SEQ ID NO: 218561 - DNA, 25 bp, E. coli
aacctggttttctgtatatgtcatg

SEQ ID NO: 218562 - DNA, 25 bp, E. coli
aacctggttttcagtatatgtcatg

SEQ ID NO: 218563 - DNA, 25 bp, E. coli
tatgtcatgttgatggaaaatatca

SEQ ID NO: 218564 - DNA, 25 bp, E. coli
tatgtcatgttgttggaaaatatca

SEQ ID NO: 218565 - DNA, 25 bp, E. coli
tttttggcatagattgatagcaggg

SEQ ID NO: 218566 - DNA, 25 bp, E. coli
tttttggcatagtttgatagcaggg

SEQ ID NO: 218567 - DNA, 25 bp, E. coli
tcttagacgcgtatttggcatagat

SEQ ID NO: 218568 - DNA, 25 bp, E. coli
tcttagacgcgtttttggcatagat

SEQ ID NO: 218569 - DNA, 25 bp, E. coli
cgtaatatcctcaactataaagtga

SEQ ID NO: 218570 - DNA, 25 bp, E. coli
cgtaatatcctctactataaagtga

SEQ ID NO: 218571 - DNA, 25 bp, E. coli
gatgcatcagatactgcaattagga

SEQ ID NO: 218572 - DNA, 25 bp, E. coli
gatgcatcagattctgcaattagga

SEQ ID NO: 218573 - DNA, 25 bp, E. coli
gagccgtcacgaatcaatttcgaca

SEQ ID NO: 218574 - DNA, 25 bp, E. coli
gagccgtcacgattcaatttcgaca

SEQ ID NO: 218575 - DNA, 25 bp, E. coli
caagcttagaccaggatggcgggat

SEQ ID NO: 218576 - DNA, 25 bp, E. coli
caagcttagacctggatggcgggat

SEQ ID NO: 218577 - DNA, 25 bp, E. coli
tactcatggtttactcctgtcagga

SEQ ID NO: 218578 - DNA, 25 bp, E. coli
tactcatggttttctcctgtcagga

SEQ ID NO: 218579 - DNA, 25 bp, E. coli
acgggtgaacaatatttaatgaaat

SEQ ID NO: 218580 - DNA, 25 bp, E. coli
acgggtgaacaaaatttaatgaaat

SEQ ID NO: 218581 - DNA, 25 bp, E. coli
tttccaagcttacaccaggatggcg

SEQ ID NO: 218582 - DNA, 25 bp, E. coli
tttccaagcttagaccaggatggcg

SEQ ID NO: 218583 - DNA, 25 bp, E. coli
ttctcacagtgaaacgtaacgtact

SEQ ID NO: 218584 - DNA, 25 bp, E. coli
ttctcacagtgatacgtaacgtact

SEQ ID NO: 218585 - DNA, 25 bp, E. coli
gaaaattgatcctttccaagcttag

SEQ ID NO: 218586 - DNA, 25 bp, E. coli
gaaaattgatccattccaagcttag

SEQ ID NO: 218587 - DNA, 25 bp, E. coli
ctcctgtcaggatcgttcggatgaa

SEQ ID NO: 218588 - DNA, 25 bp, E. coli
ctcctgtcaggaacgttcggatgaa

SEQ ID NO: 218589 - DNA, 25 bp, E. coli
gggcaatctccaatctcacagtgaa

SEQ ID NO: 218590 - DNA, 25 bp, E. coli
ggaacgttcggatgaaaattgatcc

SEQ ID NO: 218591 - DNA, 25 bp, E. coli
ggaacgttcggaagaaaattgatcc

SEQ ID NO: 218592 - DNA, 25 bp, E. coli
gggcaatctccattctcacagtgaa

SEQ ID NO: 218593 - DNA, 25 bp, E. coli
ggcgggatgggcaatctccattctc

SEQ ID NO: 218594 - DNA, 25 bp, E. coli
ggcgggatgggctatctccattctc

SEQ ID NO: 218595 - DNA, 25 bp, E. coli
taatgaaattttcagaaaagcccgt

SEQ ID NO: 218596 - DNA, 25 bp, E. coli
taatgaaattttgagaaaagcccgt

SEQ ID NO: 218597 - DNA, 25 bp, E. coli
acattaacgattacaccgtgcgcac

SEQ ID NO: 218598 - DNA, 25 bp, E. coli
acattaacgatttcaccgtgcgcac

SEQ ID NO: 218599 - DNA, 25 bp, E. coli
tatctgatcggaaaacaactcacgc

SEQ ID NO: 218600 - DNA, 25 bp, E. coli
taccatcaccatgaatggttccgat

SEQ ID NO: 218601 - DNA, 25 bp, E. coli
taccatcaccatcaatggttccgat

SEQ ID NO: 218602 - DNA, 25 bp, E. coli
tatctgatcggataacaactcacgc

SEQ ID NO: 218603 - DNA, 25 bp, E. coli
tgaagtgttgcttgtcagccgcacg

SEQ ID NO: 218604 - DNA, 25 bp, E. coli
tgcacgctgtccagcaatcgttttt

SEQ ID NO: 218605 - DNA, 25 bp, E. coli
tgaagtgttgctagtcagccgcacg

SEQ ID NO: 218606 - DNA, 25 bp, E. coli
tgcacgctgtcctgcaatcgttttt

SEQ ID NO: 218607 - DNA, 25 bp, E. coli
tgcaggagcatctgcgcgattttgt

SEQ ID NO: 218608 - DNA, 25 bp, E. coli
tgcaggagcatcagcgcgattttgt

SEQ ID NO: 218609 - DNA, 25 bp, E. coli
tctgcgcgattttgtcgttgagcaa

SEQ ID NO: 218610 - DNA, 25 bp, E. coli
tctgcgcgatttagtcgttgagcaa

SEQ ID NO: 218611 - DNA, 25 bp, E. coli
gctcgtacttttccccgtgaaacca

SEQ ID NO: 218612 - DNA, 25 bp, E. coli
gctcgtacttttgcccgtgaaacca

SEQ ID NO: 218613 - DNA, 25 bp, E. coli
cgttgagcaaagagatgatgaagtg

SEQ ID NO: 218614 - DNA, 25 bp, E. coli
cgttgagcaaagtgatgatgaagtg

SEQ ID NO: 218615 - DNA, 25 bp, E. coli
gattctgttgcggaggctcgtactt

SEQ ID NO: 218616 - DNA, 25 bp, E. coli
gattctgttgcgcaggctcgtactt

SEQ ID NO: 218617 - DNA, 25 bp, E. coli
ggaaaacaactctcgcacattaacg

SEQ ID NO: 218618 - DNA, 25 bp, E. coli
ggaaaacaactcacgcacattaacg

SEQ ID NO: 218619 - DNA, 25 bp, E. coli
cagagggcgttggagcggggttgtc

SEQ ID NO: 218620 - DNA, 25 bp, E. coli
cagagggcgttgcagcggggttgtc

SEQ ID NO: 218621 - DNA, 25 bp, E. coli
attgataacagagggcgttgcagcg

SEQ ID NO: 218622 - DNA, 25 bp, E. coli
agagggcgttgcagcggggttgtca

SEQ ID NO: 218623 - DNA, 25 bp, E. coli
ataacagagggcgttgcagcggggt

SEQ ID NO: 218624 - DNA, 25 bp, E. coli
ataacagagggccttgcagcggggt

SEQ ID NO: 218625 - DNA, 25 bp, E. coli
agagggcgttgctgcggggttgtca

SEQ ID NO: 218626 - DNA, 25 bp, E. coli
attgataacagacggcgttgcagcg

SEQ ID NO: 218627 - DNA, 25 bp, E. coli
aacagagggcgtagcagcggggttg

SEQ ID NO: 218628 - DNA, 25 bp, E. coli
acagagggcgttgcagcggggttgt

SEQ ID NO: 218629 - DNA, 25 bp, E. coli
aacagagggcgttgcagcggggttg

SEQ ID NO: 218630 - DNA, 25 bp, E. coli
acagagggcgttccagcggggttgt

SEQ ID NO: 218631 - DNA, 25 bp, E. coli
ttgataacagagcgcgttgcagcgg

SEQ ID NO: 218632 - DNA, 25 bp, E. coli
ttgataacagagggcgttgcagcgg

SEQ ID NO: 218633 - DNA, 25 bp, E. coli
tgataacagaggccgttgcagcggg

SEQ ID NO: 218634 - DNA, 25 bp, E. coli
tgataacagagggcgttgcagcggg

SEQ ID NO: 218635 - DNA, 25 bp, E. coli
gcgttgcagcggcgttgtcacttaa

SEQ ID NO: 218636 - DNA, 25 bp, E. coli
gcgttgcagcggggttgtcacttaa

SEQ ID NO: 218637 - DNA, 25 bp, E. coli
taacagagggcgatgcagcggggtt

SEQ ID NO: 218638 - DNA, 25 bp, E. coli
taacagagggcgttgcagcggggtt

SEQ ID NO: 218639 - DNA, 25 bp, E. coli
gagggcgttgcaccggggttgtcac

SEQ ID NO: 218640 - DNA, 25 bp, E. coli
gagggcgttgcagcggggttgtcac

SEQ ID NO: 218641 - DNA, 25 bp, E. coli
tacagcgctgaatttatcggttcgg

SEQ ID NO: 218642 - DNA, 25 bp, E. coli
tacagcgctgaaattatcggttcgg

SEQ ID NO: 218643 - DNA, 25 bp, E. coli
tgacctgcgtaatggttactcacga

SEQ ID NO: 218644 - DNA, 25 bp, E. coli
tgacctgcgtaaaggttactcacga

SEQ ID NO: 218645 - DNA, 25 bp, E. coli
tcgctacagcgcagaatttatcggt

SEQ ID NO: 218646 - DNA, 25 bp, E. coli
tcgctacagcgctgaatttatcggt

SEQ ID NO: 218647 - DNA, 25 bp, E. coli
tcggtgtgacctccgtaatggttac

SEQ ID NO: 218648 - DNA, 25 bp, E. coli
tcggtgtgacctgcgtaatggttac

SEQ ID NO: 218649 - DNA, 25 bp, E. coli
gaaagtcgatgtcgatgcttcggtt

SEQ ID NO: 218650 - DNA, 25 bp, E. coli
gaaagtcgatgtggatgcttcggtt

SEQ ID NO: 218651 - DNA, 25 bp, E. coli
cgctgaatttatgggttcggttaat

SEQ ID NO: 218652 - DNA, 25 bp, E. coli
cgatgtggatgcttcggttgtcgat

SEQ ID NO: 218653 - DNA, 25 bp, E. coli
cgaccactcgcttcagcgctgaatt

SEQ ID NO: 218654 - DNA, 25 bp, E. coli
cgatgtggatgcatcggttgtcgat

SEQ ID NO: 218655 - DNA, 25 bp, E. coli
cgctgaatttatcggttcggttaat

SEQ ID NO: 218656 - DNA, 25 bp, E. coli
cgaccactcgctacagcgctgaatt

SEQ ID NO: 218657 - DNA, 25 bp, E. coli
ctgcgtaatggttactcacgatcag

SEQ ID NO: 218658 - DNA, 25 bp, E. coli
cgtcagcgtgtgcccctggccagaa

SEQ ID NO: 218659 - DNA, 25 bp, E. coli
cgtcagcgtgtggccctggccagaa

SEQ ID NO: 218660 - DNA, 25 bp, E. coli
ctgcgtaatggtaactcacgatcag

SEQ ID NO: 218661 - DNA, 25 bp, E. coli
tggatgcttcggttgtcgataacgt

SEQ ID NO: 218662 - DNA, 25 bp, E. coli
tggatgcttcggatgtcgataacgt

SEQ ID NO: 218663 - DNA, 25 bp, E. coli
caagggacacatgatgcagatcggc

SEQ ID NO: 218664 - DNA, 25 bp, E. coli
caagggacacatcatgcagatcggc

SEQ ID NO: 218665 - DNA, 25 bp, E. coli
cacgatcagagcgaagcctttgcgg

SEQ ID NO: 218666 - DNA, 25 bp, E. coli
cacgatcagagccaagcctttgcgg

SEQ ID NO: 218667 - DNA, 25 bp, E. coli
cggcaaccttcaccgacggatacgt

SEQ ID NO: 218668 - DNA, 25 bp, E. coli
cggcaaccttcagcgacggatacgt

SEQ ID NO: 218669 - DNA, 25 bp, E. coli
tattattgcaggacaacgctacgcg

SEQ ID NO: 218670 - DNA, 25 bp, E. coli
tatcttgaaatcgatccgtacggca

SEQ ID NO: 218671 - DNA, 25 bp, E. coli
tattattgcaggtcaacgctacgcg

SEQ ID NO: 218672 - DNA, 25 bp, E. coli
tatcttgaaatccatccgtacggca

SEQ ID NO: 218673 - DNA, 25 bp, E. coli
tttgtcgatcagttctccggcgggc

SEQ ID NO: 218674 - DNA, 25 bp, E. coli
tttgtcgatcagatctccggcgggc

SEQ ID NO: 218675 - DNA, 25 bp, E. coli
tgaaagcccgcgacaaagaggcgtt

SEQ ID NO: 218676 - DNA, 25 bp, E. coli
tgaaagcccgcgtcaaagaggcgtt

SEQ ID NO: 218677 - DNA, 25 bp, E. coli
tctggaaggattcgaagaccgcttt

SEQ ID NO: 218678 - DNA, 25 bp, E. coli
tctggaaggattggaagaccgcttt

SEQ ID NO: 218679 - DNA, 25 bp, E. coli
tcggttatggcctgaaaatgctcgg

SEQ ID NO: 218680 - DNA, 25 bp, E. coli
tcggttatggccagaaaatgctcgg

SEQ ID NO: 218681 - DNA, 25 bp, E. coli
cgtacggcatgtatgttctggcgga

SEQ ID NO: 218682 - DNA, 25 bp, E. coli
cgtacggcatgtttgttctggcgga

SEQ ID NO: 218683 - DNA, 25 bp, E. coli
gatcctcaagcccaaagtgctgctg

SEQ ID NO: 218684 - DNA, 25 bp, E. coli
gatcctcaagccgaaagtgctgctg

SEQ ID NO: 218685 - DNA, 25 bp, E. coli
catggttaatgcacgcaaccagccg

SEQ ID NO: 218686 - DNA, 25 bp, E. coli
catggttaatgctcgcaaccagccg

SEQ ID NO: 218687 - DNA, 25 bp, E. coli
aaatcaccctttgagatataccgcg

SEQ ID NO: 218688 - DNA, 25 bp, E. coli
aaatcaccctttcagatataccgcg

SEQ ID NO: 218689 - DNA, 25 bp, E. coli
tatcaggcggcgtaataattcttct

SEQ ID NO: 218690 - DNA, 25 bp, E. coli
tatcaggcggcgaaataattcttct

SEQ ID NO: 218691 - DNA, 25 bp, E. coli
tgacccaccttatcggcaacttttg

SEQ ID NO: 218692 - DNA, 25 bp, E. coli
tgacccaccttaacggcaacttttg

SEQ ID NO: 218693 - DNA, 25 bp, E. coli
tgaatgggcgtttccagcttgctgg

SEQ ID NO: 218694 - DNA, 25 bp, E. coli
tgaatgggcgttaccagcttgctgg

SEQ ID NO: 218695 - DNA, 25 bp, E. coli
tctctatgaccgtccgggaggctaa

SEQ ID NO: 218696 - DNA, 25 bp, E. coli
tctctatgaccgaccgggaggctaa

SEQ ID NO: 218697 - DNA, 25 bp, E. coli
gctaagcccgtcttttaagctggca

SEQ ID NO: 218698 - DNA, 25 bp, E. coli
gctaagcccgtcatttaagctggca

SEQ ID NO: 218699 - DNA, 25 bp, E. coli
tccgaaggcccagcaataagaaatc

SEQ ID NO: 218700 - DNA, 25 bp, E. coli
tccgaaggcccaccaataagaaatc

SEQ ID NO: 218701 - DNA, 25 bp, E. coli
ggcaacttttgagccaccactaacg

SEQ ID NO: 218702 - DNA, 25 bp, E. coli
tggcaattgctccaagccttccgaa

SEQ ID NO: 218703 - DNA, 25 bp, E. coli
tggcaattgctcgaagccttccgaa

SEQ ID NO: 218704 - DNA, 25 bp, E. coli
ggcaacttttgacccaccactaacg

SEQ ID NO: 218705 - DNA, 25 bp, E. coli
taacggcaacttatgacccacctga

SEQ ID NO: 218706 - DNA, 25 bp, E. coli
taacggcaacttttgacccacctga

SEQ ID NO: 218707 - DNA, 25 bp, E. coli
cactaatagcctccgtgtggcacag

SEQ ID NO: 218708 - DNA, 25 bp, E. coli
cactaatagcctgcgtgtggcacag

SEQ ID NO: 218709 - DNA, 25 bp, E. coli
tataggtgccattgaacatgacggc

SEQ ID NO: 218710 - DNA, 25 bp, E. coli
tataggtgccatagaacatgacggc

SEQ ID NO: 218711 - DNA, 25 bp, E. coli
tattgaagaactggcacaactgctg

SEQ ID NO: 218712 - DNA, 25 bp, E. coli
tattgaagaactcgcacaactgctg

SEQ ID NO: 218713 - DNA, 25 bp, E. coli
tgtttcaacgcaaaccgtgcgccgg

SEQ ID NO: 218714 - DNA, 25 bp, E. coli
tgtttcaacgcataccgtgcgccgg

SEQ ID NO: 218715 - DNA, 25 bp, E. coli
tcgaagtgacaggtaatccacgcca

SEQ ID NO: 218716 - DNA, 25 bp, E. coli
tcgaagtgacagctaatccacgcca

SEQ ID NO: 218717 - DNA, 25 bp, E. coli
gcaatgcacggaatgtcagggcttt

SEQ ID NO: 218718 - DNA, 25 bp, E. coli
gcaatgcacggattgtcagggcttt

SEQ ID NO: 218719 - DNA, 25 bp, E. coli
gacggcaccctagtggaatttgatg

SEQ ID NO: 218720 - DNA, 25 bp, E. coli
gacggcaccctactggaatttgatg

SEQ ID NO: 218721 - DNA, 25 bp, E. coli
cgggatatccgaaaactcagtgagc

SEQ ID NO: 218722 - DNA, 25 bp, E. coli
cgggatatccgataactcagtgagc

SEQ ID NO: 218723 - DNA, 25 bp, E. coli
ctttacgcgctcttaacggtgggat

SEQ ID NO: 218724 - DNA, 25 bp, E. coli
ctttacgcgctcataacggtgggat

SEQ ID NO: 218725 - DNA, 25 bp, E. coli
gattttattgaaggcttccgcgcag

SEQ ID NO: 218726 - DNA, 25 bp, E. coli
gattttattgaacgcttccgcgcag

SEQ ID NO: 218727 - DNA, 25 bp, E. coli
ggttgccgagcatgaagtatcctga

SEQ ID NO: 218728 - DNA, 25 bp, E. coli
ggttgccgagcaagaagtatcctga

SEQ ID NO: 218729 - DNA, 25 bp, E. coli
aagctgacgcctcgtttgccctgaa

SEQ ID NO: 218730 - DNA, 25 bp, E. coli
aagctgacgcctggtttgccctgaa

SEQ ID NO: 218731 - DNA, 25 bp, E. coli
catgcgacggtatcagggactgaaa

SEQ ID NO: 218732 - DNA, 25 bp, E. coli
catgcgacggtaacagggactgaaa

SEQ ID NO: 218733 - DNA, 25 bp, E. coli
aactcagtcaggttgtgcaggcgct

SEQ ID NO: 218734 - DNA, 25 bp, E. coli
aaacaaattttaagccgaggtgcgg

SEQ ID NO: 218735 - DNA, 25 bp, E. coli
aaacaaattttatgccgaggtgcgg

SEQ ID NO: 218736 - DNA, 25 bp, E. coli
aactcagtcaggatgtgcaggcgct

SEQ ID NO: 218737 - DNA, 25 bp, E. coli
ttactgaaagttgcgctggcgcacg

SEQ ID NO: 218738 - DNA, 25 bp, E. coli
ttactgaaagttccgctggcgcacg

SEQ ID NO: 218739 - DNA, 25 bp, E. coli
tgcaggcgctgatcaacaatggtct

SEQ ID NO: 218740 - DNA, 25 bp, E. coli
tgcaggcgctgaacaacaatggtct

SEQ ID NO: 218741 - DNA, 25 bp, E. coli
tcggtgacctacgaagaaacccgtg

SEQ ID NO: 218742 - DNA, 25 bp, E. coli
tcggtgacctaccaagaaacccgtg

SEQ ID NO: 218743 - DNA, 25 bp, E. coli
cctagacagagaaacggacagtgct

SEQ ID NO: 218744 - DNA, 25 bp, E. coli
cctagacagagatacggacagtgct

SEQ ID NO: 218745 - DNA, 25 bp, E. coli
gattttgaatgcgaacactgcgact

SEQ ID NO: 218746 - DNA, 25 bp, E. coli
gattttgaatgccaacactgcgact

SEQ ID NO: 218747 - DNA, 25 bp, E. coli
taaagcccgtgaagagttggaggcc

SEQ ID NO: 218748 - DNA, 25 bp, E. coli
taaagcccgtgatgagttggaggcc

SEQ ID NO: 218749 - DNA, 25 bp, E. coli
gatgttgacgattctgcacccgata

SEQ ID NO: 218750 - DNA, 25 bp, E. coli
gatgttgacgatactgcacccgata

SEQ ID NO: 218751 - DNA, 25 bp, E. coli
aagctgttggccgtggtcgtctgac

SEQ ID NO: 218752 - DNA, 25 bp, E. coli
aagctgttggccctggtcgtctgac

SEQ ID NO: 218753 - DNA, 25 bp, E. coli
cagggtacggatgttagcttcggca

SEQ ID NO: 218754 - DNA, 25 bp, E. coli
cagggtacggatcttagcttcggca

SEQ ID NO: 218755 - DNA, 25 bp, E. coli
accgatcactgaaaagccgctggca

SEQ ID NO: 218756 - DNA, 25 bp, E. coli
accgatcactgataagccgctggca

SEQ ID NO: 218757 - DNA, 25 bp, E. coli
tattgggttgccttgattcagccgg

SEQ ID NO: 218758 - DNA, 25 bp, E. coli
tattgggttgccatgattcagccgg

SEQ ID NO: 218759 - DNA, 25 bp, E. coli
tgttccggaagacctggcccgtgaa

SEQ ID NO: 218760 - DNA, 25 bp, E. coli
tgttccggaagagctggcccgtgaa

SEQ ID NO: 218761 - DNA, 25 bp, E. coli
tgaagcattcaacctggcagcagcg

SEQ ID NO: 218762 - DNA, 25 bp, E. coli
tgaagcattcaagctggcagcagcg

SEQ ID NO: 218763 - DNA, 25 bp, E. coli
tcctgtatgaaaaggacggtgttcc

SEQ ID NO: 218764 - DNA, 25 bp, E. coli
tcctgtatgaaatggacggtgttcc

SEQ ID NO: 218765 - DNA, 25 bp, E. coli
cccgtgcagttaagcgtcaaggtaa

SEQ ID NO: 218766 - DNA, 25 bp, E. coli
cccgtgcagttatgcgtcaaggtaa

SEQ ID NO: 218767 - DNA, 25 bp, E. coli
cgtcagatcgaaccagcacgtcgtg

SEQ ID NO: 218768 - DNA, 25 bp, E. coli
cgtcagatcgaagcagcacgtcgtg

SEQ ID NO: 218769 - DNA, 25 bp, E. coli
tgtgttcccggagaaaccgatcact

SEQ ID NO: 218770 - DNA, 25 bp, E. coli
tgtgttcccggacaaaccgatcact

SEQ ID NO: 218771 - DNA, 25 bp, E. coli
taagatctggatccgtgtgttcccg

SEQ ID NO: 218772 - DNA, 25 bp, E. coli
taagatctggatgcgtgtgttcccg

SEQ ID NO: 218773 - DNA, 25 bp, E. coli
cactggagctttaaatggctgtaac

SEQ ID NO: 218774 - DNA, 25 bp, E. coli
cactggagcttttaatggctgtaac

SEQ ID NO: 218775 - DNA, 25 bp, E. coli
tattacgcgccagggacagtgcgtg

SEQ ID NO: 218776 - DNA, 25 bp, E. coli
tattacgcgccacggacagtgcgtg

SEQ ID NO: 218777 - DNA, 25 bp, E. coli
tgcgcgagttagtaaaccaacataa

SEQ ID NO: 218778 - DNA, 25 bp, E. coli
tgcgcgagttagaaaaccaacataa

SEQ ID NO: 218779 - DNA, 25 bp, E. coli
cctgttgtacagttaaatgcgaatg

SEQ ID NO: 218780 - DNA, 25 bp, E. coli
cctgttgtacagataaatgcgaatg

SEQ ID NO: 218781 - DNA, 25 bp, E. coli
gcattcagccagtcatcacacctgt

SEQ ID NO: 218782 - DNA, 25 bp, E. coli
gcattcagccagacatcacacctgt

SEQ ID NO: 218783 - DNA, 25 bp, E. coli
gcagagaatatatacaaatcgcccc

SEQ ID NO: 218784 - DNA, 25 bp, E. coli
gcagagaatataaacaaatcgcccc

SEQ ID NO: 218785 - DNA, 25 bp, E. coli
gaaaaacagcgaatgtctctatcat

SEQ ID NO: 218786 - DNA, 25 bp, E. coli
gacggaacgccatagaaaaacagcg

SEQ ID NO: 218787 - DNA, 25 bp, E. coli
gaaaaacagcgattgtctctatcat

SEQ ID NO: 218788 - DNA, 25 bp, E. coli
gaaaaggaacaaaattacgcgccag

SEQ ID NO: 218789 - DNA, 25 bp, E. coli
gaaaaggaacaatattacgcgccag

SEQ ID NO: 218790 - DNA, 25 bp, E. coli
gacggaacgccaaagaaaaacagcg

SEQ ID NO: 218791 - DNA, 25 bp, E. coli
cgaatgaatgggaaacactggagct

SEQ ID NO: 218792 - DNA, 25 bp, E. coli
cgaatgaatgggtaacactggagct

SEQ ID NO: 218793 - DNA, 25 bp, E. coli
ctgtaacaggccagagaaaaggaac

SEQ ID NO: 218794 - DNA, 25 bp, E. coli
ctgtaacaggcctgagaaaaggaac

SEQ ID NO: 218795 - DNA, 25 bp, E. coli
cacagagtgtcgtgatatcggcagg

SEQ ID NO: 218796 - DNA, 25 bp, E. coli
cacagagtgtcgagatatcggcagg

SEQ ID NO: 218797 - DNA, 25 bp, E. coli
tacagtgcgcagattctcaaaacgg

SEQ ID NO: 218798 - DNA, 25 bp, E. coli
taaattgcggcagaggccacagagt

SEQ ID NO: 218799 - DNA, 25 bp, E. coli
taaattgcggcacaggccacagagt

SEQ ID NO: 218800 - DNA, 25 bp, E. coli
tacagtgcgcagtttctcaaaacgg

SEQ ID NO: 218801 - DNA, 25 bp, E. coli
tatcgggatcactcattcgtggtgg

SEQ ID NO: 218802 - DNA, 25 bp, E. coli
tatggcttgccgtgcagtcgctaaa

SEQ ID NO: 218803 - DNA, 25 bp, E. coli
tatggcttgccgagcagtcgctaaa

SEQ ID NO: 218804 - DNA, 25 bp, E. coli
tatcgggatcacacattcgtggtgg

SEQ ID NO: 218805 - DNA, 25 bp, E. coli
tgccatgacattccgtgaaaacgga

SEQ ID NO: 218806 - DNA, 25 bp, E. coli
tgccatgacattgcgtgaaaacgga

SEQ ID NO: 218807 - DNA, 25 bp, E. coli
tcttgccggacacagctgggaatac

SEQ ID NO: 218808 - DNA, 25 bp, E. coli
tcttgccggacagagctgggaatac

SEQ ID NO: 218809 - DNA, 25 bp, E. coli
cctcaggaattgtaccagcgcagtt

SEQ ID NO: 218810 - DNA, 25 bp, E. coli
cctcaggaattgaaccagcgcagtt

SEQ ID NO: 218811 - DNA, 25 bp, E. coli
gcagttcgcagctctatcaaccggt

SEQ ID NO: 218812 - DNA, 25 bp, E. coli
gcagttcgcagcactatcaaccggt

SEQ ID NO: 218813 - DNA, 25 bp, E. coli
gacagcatgtcattgcgggaagccc

SEQ ID NO: 218814 - DNA, 25 bp, E. coli
gacagcatgtcaatgcgggaagccc

SEQ ID NO: 218815 - DNA, 25 bp, E. coli
gacctgccgaatccgctgaaatgtg

SEQ ID NO: 218816 - DNA, 25 bp, E. coli
gacctgccgaatgcgctgaaatgtg

SEQ ID NO: 218817 - DNA, 25 bp, E. coli
catgatctgcacattgccatcttaa

SEQ ID NO: 218818 - DNA, 25 bp, E. coli
cataatgtctttatattcacaacaa

SEQ ID NO: 218819 - DNA, 25 bp, E. coli
cataatgtctttttattcacaacaa

SEQ ID NO: 218820 - DNA, 25 bp, E. coli
catgatctgcactttgccatcttaa

SEQ ID NO: 218821 - DNA, 25 bp, E. coli
taacatgatctggacattgccatct

SEQ ID NO: 218822 - DNA, 25 bp, E. coli
ataaggaatatacgctaccgcccca

SEQ ID NO: 218823 - DNA, 25 bp, E. coli
ataaggaatataggctaccgcccca

SEQ ID NO: 218824 - DNA, 25 bp, E. coli
tataaggaatatacgctaccgcccc

SEQ ID NO: 218825 - DNA, 25 bp, E. coli
tataaggaatattcgctaccgcccc

SEQ ID NO: 218826 - DNA, 25 bp, E. coli
tgtataaggaatatacgctaccgcc

SEQ ID NO: 218827 - DNA, 25 bp, E. coli
tgtataaggaatttacgctaccgcc

SEQ ID NO: 218828 - DNA, 25 bp, E. coli
tgcaaagtcaaagcaatattcataa

SEQ ID NO: 218829 - DNA, 25 bp, E. coli
tgcaaagtcaaaccaatattcataa

SEQ ID NO: 218830 - DNA, 25 bp, E. coli
ccaccctgataacatgatctgcaca

SEQ ID NO: 218831 - DNA, 25 bp, E. coli
ccaccctgataagatgatctgcaca

SEQ ID NO: 218832 - DNA, 25 bp, E. coli
cctgataacatgttctgcacattgc

SEQ ID NO: 218833 - DNA, 25 bp, E. coli
cctgataacatgatctgcacattgc

SEQ ID NO: 218834 - DNA, 25 bp, E. coli
gtcaaaccaatattcataatgtctt

SEQ ID NO: 218835 - DNA, 25 bp, E. coli
gataacatgatctgcacattgccat

SEQ ID NO: 218836 - DNA, 25 bp, E. coli
gataacatgatcagcacattgccat

SEQ ID NO: 218837 - DNA, 25 bp, E. coli
gtcaaaccaataatcataatgtctt

SEQ ID NO: 218838 - DNA, 25 bp, E. coli
taacatgatctgcacattgccatct

SEQ ID NO: 218839 - DNA, 25 bp, E. coli
caatggccgccattactggttacgt

SEQ ID NO: 218840 - DNA, 25 bp, E. coli
caatggccgccaatactggttacgt

SEQ ID NO: 218841 - DNA, 25 bp, E. coli
tactggttacgtaaagatgtcctcg

SEQ ID NO: 218842 - DNA, 25 bp, E. coli
tacattttctgttcgagaaagtctg

SEQ ID NO: 218843 - DNA, 25 bp, E. coli
tactggttacgttaagatgtcctcg

SEQ ID NO: 218844 - DNA, 25 bp, E. coli
tacattttctgtacgagaaagtctg

SEQ ID NO: 218845 - DNA, 25 bp, E. coli
tattgagataacaaagaggtttcct

SEQ ID NO: 218846 - DNA, 25 bp, E. coli
tattgagataactaagaggtttcct

SEQ ID NO: 218847 - DNA, 25 bp, E. coli
ttagctacaaatgtcaaaccattcg

SEQ ID NO: 218848 - DNA, 25 bp, E. coli
ttagctacaaatctcaaaccattcg

SEQ ID NO: 218849 - DNA, 25 bp, E. coli
tcccggatacatgtcaatcacagct

SEQ ID NO: 218850 - DNA, 25 bp, E. coli
tcccggatacatctcaatcacagct

SEQ ID NO: 218851 - DNA, 25 bp, E. coli
gctcatttcaactgctgagttagct

SEQ ID NO: 218852 - DNA, 25 bp, E. coli
gctacctcgcccaaaacaaatcaat

SEQ ID NO: 218853 - DNA, 25 bp, E. coli
gctacctcgccctaaacaaatcaat

SEQ ID NO: 218854 - DNA, 25 bp, E. coli
gctcatttcaacagctgagttagct

SEQ ID NO: 218855 - DNA, 25 bp, E. coli
gatttatagcgatgttgccccgaga

SEQ ID NO: 218856 - DNA, 25 bp, E. coli
tcgtaaatggctttgtcaggacaaa

SEQ ID NO: 218857 - DNA, 25 bp, E. coli
gatttatagcgaagttgccccgaga

SEQ ID NO: 218858 - DNA, 25 bp, E. coli
tcgtaaatggctatgtcaggacaaa

SEQ ID NO: 218859 - DNA, 25 bp, E. coli
gggcaacactgagaaatttcagata

SEQ ID NO: 218860 - DNA, 25 bp, E. coli
gggcaacactgacaaatttcagata

SEQ ID NO: 218861 - DNA, 25 bp, E. coli
caaaacgggtgatgtgcttcgtgtc

SEQ ID NO: 218862 - DNA, 25 bp, E. coli
caaaacgggtgaagtgcttcgtgtc

SEQ ID NO: 218863 - DNA, 25 bp, E. coli
caccatccgcgacgagtctgaatcg

SEQ ID NO: 218864 - DNA, 25 bp, E. coli
caccatccgcgaggagtctgaatcg

SEQ ID NO: 218865 - DNA, 25 bp, E. coli
catgcagagcaggaaaatatgaccc

SEQ ID NO: 218866 - DNA, 25 bp, E. coli
catgcagagcagcaaaatatgaccc

SEQ ID NO: 218867 - DNA, 25 bp, E. coli
tatttttgcacgattgaagtcaccg

SEQ ID NO: 218868 - DNA, 25 bp, E. coli
tatttttgcacgtttgaagtcaccg

SEQ ID NO: 218869 - DNA, 25 bp, E. coli
ttttttcaacgtatccaggatgaca

SEQ ID NO: 218870 - DNA, 25 bp, E. coli
ttccaggatgactttctggctgggc

SEQ ID NO: 218871 - DNA, 25 bp, E. coli
ttttttcaacgtttccaggatgaca

SEQ ID NO: 218872 - DNA, 25 bp, E. coli
ttccaggatgacattctggctgggc

SEQ ID NO: 218873 - DNA, 25 bp, E. coli
tgcagccaaacgtcatcactttttt

SEQ ID NO: 218874 - DNA, 25 bp, E. coli
tgcagccaaacgacatcactttttt

SEQ ID NO: 218875 - DNA, 25 bp, E. coli
tctgaatcgcacttcaaaacgggtg

SEQ ID NO: 218876 - DNA, 25 bp, E. coli
tcgtgtcggacgatttgaagatgac

SEQ ID NO: 218877 - DNA, 25 bp, E. coli
tctgaatcgcacatcaaaacgggtg

SEQ ID NO: 218878 - DNA, 25 bp, E. coli
tcgtgtcggacgttttgaagatgac

SEQ ID NO: 218879 - DNA, 25 bp, E. coli
gcaacctcaaccctaacgctggata

SEQ ID NO: 218880 - DNA, 25 bp, E. coli
gcaacctcaaccgtaacgctggata

SEQ ID NO: 218881 - DNA, 25 bp, E. coli
gaaaatatgaccctgactgaactga

SEQ ID NO: 218882 - DNA, 25 bp, E. coli
gaaaatatgaccgtgactgaactga

SEQ ID NO: 218883 - DNA, 25 bp, E. coli
tactctcggtagcaacggcagcatt

SEQ ID NO: 218884 - DNA, 25 bp, E. coli
tactctcggtaggaacggcagcatt

SEQ ID NO: 218885 - DNA, 25 bp, E. coli
agtactctcggtagcaacggcagca

SEQ ID NO: 218886 - DNA, 25 bp, E. coli
agtactctcggttgcaacggcagca

SEQ ID NO: 218887 - DNA, 25 bp, E. coli
actctcggtagcaacggcagcattt

SEQ ID NO: 218888 - DNA, 25 bp, E. coli
actctcggtagctacggcagcattt

SEQ ID NO: 218889 - DNA, 25 bp, E. coli
tagtactctcggtagcaacggcagc

SEQ ID NO: 218890 - DNA, 25 bp, E. coli
tagtactctcggaagcaacggcagc

SEQ ID NO: 218891 - DNA, 25 bp, E. coli
ttagtactctcggtagcaacggcag

SEQ ID NO: 218892 - DNA, 25 bp, E. coli
ttagtactctcgctagcaacggcag

SEQ ID NO: 218893 - DNA, 25 bp, E. coli
tctcggtagcaacggcagcattttc

SEQ ID NO: 218894 - DNA, 25 bp, E. coli
tctcggtagcaagggcagcattttc

SEQ ID NO: 218895 - DNA, 25 bp, E. coli
ctctcggtagcaacggcagcatttt

SEQ ID NO: 218896 - DNA, 25 bp, E. coli
cggtagcaacgggagcattttcatt

SEQ ID NO: 218897 - DNA, 25 bp, E. coli
ctctcggtagcatcggcagcatttt

SEQ ID NO: 218898 - DNA, 25 bp, E. coli
cggtagcaacggcagcattttcatt

SEQ ID NO: 218899 - DNA, 25 bp, E. coli
ctcggtagcaacggcagcattttca

SEQ ID NO: 218900 - DNA, 25 bp, E. coli
ctcggtagcaaccgcagcattttca

SEQ ID NO: 218901 - DNA, 25 bp, E. coli
gtactctcggtagcaacggcagcat

SEQ ID NO: 218902 - DNA, 25 bp, E. coli
ggtagcaacggcagcattttcatta

SEQ ID NO: 218903 - DNA, 25 bp, E. coli
ggtagcaacggctgcattttcatta

SEQ ID NO: 218904 - DNA, 25 bp, E. coli
gtactctcggtaccaacggcagcat

SEQ ID NO: 218905 - DNA, 25 bp, E. coli
aagtcgatccgcttacgggctggat

SEQ ID NO: 218906 - DNA, 25 bp, E. coli
aagtcgatccgcatacgggctggat

SEQ ID NO: 218907 - DNA, 25 bp, E. coli
cacgggcattccattatggtgcgac

SEQ ID NO: 218908 - DNA, 25 bp, E. coli
cacgggcattcctttatggtgcgac

SEQ ID NO: 218909 - DNA, 25 bp, E. coli
taaacccgttgtcccgctgttaagt

SEQ ID NO: 218910 - DNA, 25 bp, E. coli
tatctcaatgatattccaggtctgg

SEQ ID NO: 218911 - DNA, 25 bp, E. coli
tatggtgcgactggaaattaccggg

SEQ ID NO: 218912 - DNA, 25 bp, E. coli
tatggtgcgactcgaaattaccggg

SEQ ID NO: 218913 - DNA, 25 bp, E. coli
tatctcaatgattttccaggtctgg

SEQ ID NO: 218914 - DNA, 25 bp, E. coli
tgatgtccaccacgttatttaaaga

SEQ ID NO: 218915 - DNA, 25 bp, E. coli
tgatgtccaccaggttatttaaaga

SEQ ID NO: 218916 - DNA, 25 bp, E. coli
tgatggtaaaagaaacctgcaccgc

SEQ ID NO: 218917 - DNA, 25 bp, E. coli
tgatggtaaaagtaacctgcaccgc

SEQ ID NO: 218918 - DNA, 25 bp, E. coli
gcataaatgtggacgcctgcacggg

SEQ ID NO: 218919 - DNA, 25 bp, E. coli
gcataaatgtggtcgcctgcacggg

SEQ ID NO: 218920 - DNA, 25 bp, E. coli
tggatttgggatcaggttaaacccg

SEQ ID NO: 218921 - DNA, 25 bp, E. coli
tggatttgggatgaggttaaacccg

SEQ ID NO: 218922 - DNA, 25 bp, E. coli
cgggctggattatcgatttcgctga

SEQ ID NO: 218923 - DNA, 25 bp, E. coli
cgggctggattaacgatttcgctga

SEQ ID NO: 218924 - DNA, 25 bp, E. coli
taaacccgttgtgccgctgttaagt

SEQ ID NO: 218925 - DNA, 25 bp, E. coli
gagcgcctcgatgaccattatctca

SEQ ID NO: 218926 - DNA, 25 bp, E. coli
gagcgcctcgatcaccattatctca

SEQ ID NO: 218927 - DNA, 25 bp, E. coli
atatctatcttcagcctcttgctcg

SEQ ID NO: 218928 - DNA, 25 bp, E. coli
atatctatcttctgcctcttgctcg

SEQ ID NO: 218929 - DNA, 25 bp, E. coli
ttatccccggtgttgaagatgcgcc

SEQ ID NO: 218930 - DNA, 25 bp, E. coli
ttatccccggtgatgaagatgcgcc

SEQ ID NO: 218931 - DNA, 25 bp, E. coli
tcgaaagtgagttaacacgtaaata

SEQ ID NO: 218932 - DNA, 25 bp, E. coli
tcgaaagtgagtaaacacgtaaata

SEQ ID NO: 218933 - DNA, 25 bp, E. coli
tcatcatccaaatgtcgaaagtgag

SEQ ID NO: 218934 - DNA, 25 bp, E. coli
tcatcatccaaaagtcgaaagtgag

SEQ ID NO: 218935 - DNA, 25 bp, E. coli
gcctggatacggtaaatatctatct

SEQ ID NO: 218936 - DNA, 25 bp, E. coli
gcctggatacggaaaatatctatct

SEQ ID NO: 218937 - DNA, 25 bp, E. coli
gaacgtgcacgcctggatacggaaa

SEQ ID NO: 218938 - DNA, 25 bp, E. coli
gaacgtgcacgcgtggatacggaaa

SEQ ID NO: 218939 - DNA, 25 bp, E. coli
cgtaaatatgaaggtgcacgcctgg

SEQ ID NO: 218940 - DNA, 25 bp, E. coli
cgtaaatatgaacgtgcacgcctgg

SEQ ID NO: 218941 - DNA, 25 bp, E. coli
cggtgatgaagaagcgccactcaaa

SEQ ID NO: 218942 - DNA, 25 bp, E. coli
cggtgatgaagatgcgccactcaaa

SEQ ID NO: 218943 - DNA, 25 bp, E. coli
gtaaagaatcctcgccatttaatta

SEQ ID NO: 218944 - DNA, 25 bp, E. coli
gtaaagaatcctggccatttaatta

SEQ ID NO: 218945 - DNA, 25 bp, E. coli
gataatcacttccttcatcatccaa

SEQ ID NO: 218946 - DNA, 25 bp, E. coli
gataatcacttcgttcatcatccaa

SEQ ID NO: 218947 - DNA, 25 bp, E. coli
gatgcgccactctaacgcatgactc

SEQ ID NO: 218948 - DNA, 25 bp, E. coli
gatgcgccactcaaacgcatgactc

SEQ ID NO: 218949 - DNA, 25 bp, E. coli
caaaggcgaagaactgcgtgagcaa

SEQ ID NO: 218950 - DNA, 25 bp, E. coli
caaaggcgaagatctgcgtgagcaa

SEQ ID NO: 218951 - DNA, 25 bp, E. coli
catttgccattaggcgcggactgaa

SEQ ID NO: 218952 - DNA, 25 bp, E. coli
catttgccattacgcgcggactgaa

SEQ ID NO: 218953 - DNA, 25 bp, E. coli
taaagaagcgccagtgtacgcgtgc

SEQ ID NO: 218954 - DNA, 25 bp, E. coli
taaagcgccggtagaacagtggtct

SEQ ID NO: 218955 - DNA, 25 bp, E. coli
taaagaagcgcctgtgtacgcgtgc

SEQ ID NO: 218956 - DNA, 25 bp, E. coli
taaagcgccggttgaacagtggtct

SEQ ID NO: 218957 - DNA, 25 bp, E. coli
tattgctggcgcaggattacaaccc

SEQ ID NO: 218958 - DNA, 25 bp, E. coli
tattgctggcgctggattacaaccc

SEQ ID NO: 218959 - DNA, 25 bp, E. coli
tgatgaacactgttgccgaagggcg

SEQ ID NO: 218960 - DNA, 25 bp, E. coli
tgacagaagcgatgaagattaccct

SEQ ID NO: 218961 - DNA, 25 bp, E. coli
tgacagaagcgaagaagattaccct

SEQ ID NO: 218962 - DNA, 25 bp, E. coli
tgatgaacactgatgccgaagggcg

SEQ ID NO: 218963 - DNA, 25 bp, E. coli
cctgatgatcatggactgggtgcgt

SEQ ID NO: 218964 - DNA, 25 bp, E. coli
cctgatgatcatcgactgggtgcgt

SEQ ID NO: 218965 - DNA, 25 bp, E. coli
gctgggcattctcgcaaggttacaa

SEQ ID NO: 218966 - DNA, 25 bp, E. coli
gctgggcattctggcaaggttacaa

SEQ ID NO: 218967 - DNA, 25 bp, E. coli
gactgctcggcgtcttaccgtaaag

SEQ ID NO: 218968 - DNA, 25 bp, E. coli
gactgctcggcgacttaccgtaaag

SEQ ID NO: 218969 - DNA, 25 bp, E. coli
ggcaatgcgttcaagctgggcgata

SEQ ID NO: 218970 - DNA, 25 bp, E. coli
ggcaatgcgttctagctgggcgata

SEQ ID NO: 218971 - DNA, 25 bp, E. coli
aatacagatgtacttgacgcggcgg

SEQ ID NO: 218972 - DNA, 25 bp, E. coli
aatacagatgtagttgacgcggcgg

SEQ ID NO: 218973 - DNA, 25 bp, E. coli
caaacggtttgaaaatgcggatgcc

SEQ ID NO: 218974 - DNA, 25 bp, E. coli
caaacggtttgataatgcggatgcc

SEQ ID NO: 218975 - DNA, 25 bp, E. coli
tactgggacatacggaaaacggact

SEQ ID NO: 218976 - DNA, 25 bp, E. coli
tactgggacatagggaaaacggact

SEQ ID NO: 218977 - DNA, 25 bp, E. coli
tattcgtcctgataccggagcgggc

SEQ ID NO: 218978 - DNA, 25 bp, E. coli
tattcgtcctgaaaccggagcgggc

SEQ ID NO: 218979 - DNA, 25 bp, E. coli
ttaccggatgatgtggaagcaaccc

SEQ ID NO: 218980 - DNA, 25 bp, E. coli
ttaccggatgatctggaagcaaccc

SEQ ID NO: 218981 - DNA, 25 bp, E. coli
tgatatcacgcagtcagtagcccgt

SEQ ID NO: 218982 - DNA, 25 bp, E. coli
tgatatcacgcactcagtagcccgt

SEQ ID NO: 218983 - DNA, 25 bp, E. coli
tcatggagttattcgggagccagcc

SEQ ID NO: 218984 - DNA, 25 bp, E. coli
tcatggagttatacgggagccagcc

SEQ ID NO: 218985 - DNA, 25 bp, E. coli
gaagggcctgtaattgcaaccggag

SEQ ID NO: 218986 - DNA, 25 bp, E. coli
gaagggcctgtatttgcaaccggag

SEQ ID NO: 218987 - DNA, 25 bp, E. coli
gattataatgcactggcagccggtg

SEQ ID NO: 218988 - DNA, 25 bp, E. coli
gattataatgcagtggcagccggtg

SEQ ID NO: 218989 - DNA, 25 bp, E. coli
tggattataaccacaacgggacggt

SEQ ID NO: 218990 - DNA, 25 bp, E. coli
tggattataacctcaacgggacggt

SEQ ID NO: 218991 - DNA, 25 bp, E. coli
taaccagtgaaataggccgggagct

SEQ ID NO: 218992 - DNA, 25 bp, E. coli
taaccagtgaaaaaggccgggagct

SEQ ID NO: 218993 - DNA, 25 bp, E. coli
aatggcgcttgttcatctatttccc

SEQ ID NO: 218994 - DNA, 25 bp, E. coli
aatggcgcttgtacatctatttccc

SEQ ID NO: 218995 - DNA, 25 bp, E. coli
cacttcgcgaagatttaacaggtca

SEQ ID NO: 218996 - DNA, 25 bp, E. coli
cacttcgcgaagttttaacaggtca

SEQ ID NO: 218997 - DNA, 25 bp, E. coli
tatactgccctatcacttcgcgaag

SEQ ID NO: 218998 - DNA, 25 bp, E. coli
tatactgccctaacacttcgcgaag

SEQ ID NO: 218999 - DNA, 25 bp, E. coli
taacatccgcattatttccagcaat

SEQ ID NO: 219000 - DNA, 25 bp, E. coli
acttttcattattctgtgctaccac

SEQ ID NO: 219001 - DNA, 25 bp, E. coli
acttttcattatactgtgctaccac

SEQ ID NO: 219002 - DNA, 25 bp, E. coli
taccacagaaaaactataacgcttg

SEQ ID NO: 219003 - DNA, 25 bp, E. coli
taccacagaaaatctataacgcttg

SEQ ID NO: 219004 - DNA, 25 bp, E. coli
tatcacgggagaatagagaatcatc

SEQ ID NO: 219005 - DNA, 25 bp, E. coli
tatttgtacagcaaaatggcgcttg

SEQ ID NO: 219006 - DNA, 25 bp, E. coli
tatcacgggagattagagaatcatc

SEQ ID NO: 219007 - DNA, 25 bp, E. coli
tatttgtacagctaaatggcgcttg

SEQ ID NO: 219008 - DNA, 25 bp, E. coli
cccaatgcaggatgataaatatcac

SEQ ID NO: 219009 - DNA, 25 bp, E. coli
cccaatgcaggaagataaatatcac

SEQ ID NO: 219010 - DNA, 25 bp, E. coli
taacatccgcataatttccagcaat

SEQ ID NO: 219011 - DNA, 25 bp, E. coli
gagtctggaatttcacactgtaccc

SEQ ID NO: 219012 - DNA, 25 bp, E. coli
gagtctggaattacacactgtaccc

SEQ ID NO: 219013 - DNA, 25 bp, E. coli
gagaatcatcaatcaggtaagagtc

SEQ ID NO: 219014 - DNA, 25 bp, E. coli
gagaatcatcaaacaggtaagagtc

SEQ ID NO: 219015 - DNA, 25 bp, E. coli
aatcattaaagcctacgacggtgag

SEQ ID NO: 219016 - DNA, 25 bp, E. coli
aatcattaaagcgtacgacggtgag

SEQ ID NO: 219017 - DNA, 25 bp, E. coli
tacgtgttgatcagcgacaccgacg

SEQ ID NO: 219018 - DNA, 25 bp, E. coli
tacctcgggaatttctaagtatgag

SEQ ID NO: 219019 - DNA, 25 bp, E. coli
acctatatgggtcgcgcgtacgtgt

SEQ ID NO: 219020 - DNA, 25 bp, E. coli
acctatatgggtggcgcgtacgtgt

SEQ ID NO: 219021 - DNA, 25 bp, E. coli
aaaaataagatgatgctgggtgcgc

SEQ ID NO: 219022 - DNA, 25 bp, E. coli
aaaaataagatgttgctgggtgcgc

SEQ ID NO: 219023 - DNA, 25 bp, E. coli
tacctcgggaatatctaagtatgag

SEQ ID NO: 219024 - DNA, 25 bp, E. coli
tacgtgttgatctgcgacaccgacg

SEQ ID NO: 219025 - DNA, 25 bp, E. coli
ttgctggttacctgtgccgcctggg

SEQ ID NO: 219026 - DNA, 25 bp, E. coli
ttgctggttaccagtgccgcctggg

SEQ ID NO: 219027 - DNA, 25 bp, E. coli
tgagtacaacattaagcagtggcag

SEQ ID NO: 219028 - DNA, 25 bp, E. coli
tgagtacaacataaagcagtggcag

SEQ ID NO: 219029 - DNA, 25 bp, E. coli
tcgaccaatacctcgggaatttcta

SEQ ID NO: 219030 - DNA, 25 bp, E. coli
tcgaccaataccacgggaatttcta

SEQ ID NO: 219031 - DNA, 25 bp, E. coli
gcgacaccgacgctaaaatcattaa

SEQ ID NO: 219032 - DNA, 25 bp, E. coli
ccgggacgcactcgacctatatggg

SEQ ID NO: 219033 - DNA, 25 bp, E. coli
gcgacaccgacggtaaaatcattaa

SEQ ID NO: 219034 - DNA, 25 bp, E. coli
ccgggacgcactggacctatatggg

SEQ ID NO: 219035 - DNA, 25 bp, E. coli
cgacggtgagattttttatcatcgc

SEQ ID NO: 219036 - DNA, 25 bp, E. coli
cgacggtgagatattttatcatcgc

SEQ ID NO: 219037 - DNA, 25 bp, E. coli
caacgtgaacttttgcggatctcca

SEQ ID NO: 219038 - DNA, 25 bp, E. coli
caacgtgaacttatgcggatctcca

SEQ ID NO: 219039 - DNA, 25 bp, E. coli
cactgcccgtttcgagagtttctca

SEQ ID NO: 219040 - DNA, 25 bp, E. coli
cactgcccgtttggagagtttctca

SEQ ID NO: 219041 - DNA, 25 bp, E. coli
taaagccaacgtcaacttttgcgga

SEQ ID NO: 219042 - DNA, 25 bp, E. coli
taaagccaacgtgaacttttgcgga

SEQ ID NO: 219043 - DNA, 25 bp, E. coli
cttgaagtcactccccgtttcgaga

SEQ ID NO: 219044 - DNA, 25 bp, E. coli
cttgaagtcactgcccgtttcgaga

SEQ ID NO: 219045 - DNA, 25 bp, E. coli
ttttaacccttgaagtcactgcccg

SEQ ID NO: 219046 - DNA, 25 bp, E. coli
ttttaacccttgtagtcactgcccg

SEQ ID NO: 219047 - DNA, 25 bp, E. coli
tgaacttttgcggatctccaggatc

SEQ ID NO: 219048 - DNA, 25 bp, E. coli
tcgaataactaaagccaacgtgaac

SEQ ID NO: 219049 - DNA, 25 bp, E. coli
tgaacttttgcgcatctccaggatc

SEQ ID NO: 219050 - DNA, 25 bp, E. coli
tcgaataactaatgccaacgtgaac

SEQ ID NO: 219051 - DNA, 25 bp, E. coli
tcgagagtttctgaactcgaataac

SEQ ID NO: 219052 - DNA, 25 bp, E. coli
tcgagagtttctcaactcgaataac

SEQ ID NO: 219053 - DNA, 25 bp, E. coli
cttttgcggatcaccaggatccgct

SEQ ID NO: 219054 - DNA, 25 bp, E. coli
cttttgcggatctccaggatccgct

SEQ ID NO: 219055 - DNA, 25 bp, E. coli
tcaactcgaatatctaaagccaacg

SEQ ID NO: 219056 - DNA, 25 bp, E. coli
tcaactcgaataactaaagccaacg

SEQ ID NO: 219057 - DNA, 25 bp, E. coli
gagcggcacctcttttaacccttga

SEQ ID NO: 219058 - DNA, 25 bp, E. coli
gagcggcacctcatttaacccttga

SEQ ID NO: 219059 - DNA, 25 bp, E. coli
caagatctcactacgggacgggtta

SEQ ID NO: 219060 - DNA, 25 bp, E. coli
caagatctcacttcgggacgggtta

SEQ ID NO: 219061 - DNA, 25 bp, E. coli
cacgctcactatccaggttgctcgt

SEQ ID NO: 219062 - DNA, 25 bp, E. coli
cacgctcactatgcaggttgctcgt

SEQ ID NO: 219063 - DNA, 25 bp, E. coli
catggcaagatctcacttcgggacg

SEQ ID NO: 219064 - DNA, 25 bp, E. coli
catggcaagatcacacttcgggacg

SEQ ID NO: 219065 - DNA, 25 bp, E. coli
agctcccgctgctgctgacaggcgt

SEQ ID NO: 219066 - DNA, 25 bp, E. coli
agctcccgctgcagctgacaggcgt

SEQ ID NO: 219067 - DNA, 25 bp, E. coli
tccattctcggtggcgcgcgcagca

SEQ ID NO: 219068 - DNA, 25 bp, E. coli
tccattctcggtcgcgcgcgcagca

SEQ ID NO: 219069 - DNA, 25 bp, E. coli
ccgtaccattgtagaatcaggtcaa

SEQ ID NO: 219070 - DNA, 25 bp, E. coli
ccgtaccattgttgaatcaggtcaa

SEQ ID NO: 219071 - DNA, 25 bp, E. coli
gctgcagctgacaggcgttcgcgat

SEQ ID NO: 219072 - DNA, 25 bp, E. coli
gctgcagctgactggcgttcgcgat

SEQ ID NO: 219073 - DNA, 25 bp, E. coli
gacgggttatttccggtggcagcac

SEQ ID NO: 219074 - DNA, 25 bp, E. coli
gacgggttatttgcggtggcagcac

SEQ ID NO: 219075 - DNA, 25 bp, E. coli
ccgaactcagtcactcgtggcgtta

SEQ ID NO: 219076 - DNA, 25 bp, E. coli
cgcgcagcatggcaagatctcactt

SEQ ID NO: 219077 - DNA, 25 bp, E. coli
cgcgcagcatgggaagatctcactt

SEQ ID NO: 219078 - DNA, 25 bp, E. coli
ccgaactcagtctctcgtggcgtta

SEQ ID NO: 219079 - DNA, 25 bp, E. coli
ggttgctcgtctccttgatcctcac

SEQ ID NO: 219080 - DNA, 25 bp, E. coli
ggttgctcgtctgcttgatcctcac

SEQ ID NO: 219081 - DNA, 25 bp, E. coli
cagacgcttagccaacaagaaagcc

SEQ ID NO: 219082 - DNA, 25 bp, E. coli
cagacgcttagcgaacaagaaagcc

SEQ ID NO: 219083 - DNA, 25 bp, E. coli
agctgaagccggtacaactggcggc

SEQ ID NO: 219084 - DNA, 25 bp, E. coli
agctgaagccggaacaactggcggc

SEQ ID NO: 219085 - DNA, 25 bp, E. coli
tagccaacaagatagccaccagctg

SEQ ID NO: 219086 - DNA, 25 bp, E. coli
tagccaacaagaaagccaccagctg

SEQ ID NO: 219087 - DNA, 25 bp, E. coli
tgcgccgaagtatcacaccggattc

SEQ ID NO: 219088 - DNA, 25 bp, E. coli
tgcgccgaagtaacacaccggattc

SEQ ID NO: 219089 - DNA, 25 bp, E. coli
tcctcacccgctagcgtggcaagct

SEQ ID NO: 219090 - DNA, 25 bp, E. coli
tcctcacccgcttgcgtggcaagct

SEQ ID NO: 219091 - DNA, 25 bp, E. coli
gccgaagtatcacaccggattccgc

SEQ ID NO: 219092 - DNA, 25 bp, E. coli
gccaccagctgtattcagcggtggt

SEQ ID NO: 219093 - DNA, 25 bp, E. coli
gccaccagctgttttcagcggtggt

SEQ ID NO: 219094 - DNA, 25 bp, E. coli
gccgaagtatcagaccggattccgc

SEQ ID NO: 219095 - DNA, 25 bp, E. coli
gaagccggttgtttgccggaactcc

SEQ ID NO: 219096 - DNA, 25 bp, E. coli
gaagccggttgtatgccggaactcc

SEQ ID NO: 219097 - DNA, 25 bp, E. coli
gaaagccaccaggtgttttcagcgg

SEQ ID NO: 219098 - DNA, 25 bp, E. coli
gaaagccaccagctgttttcagcgg

SEQ ID NO: 219099 - DNA, 25 bp, E. coli
gttgtatgccggaactcctcacccg

SEQ ID NO: 219100 - DNA, 25 bp, E. coli
gttgtatgccggtactcctcacccg

SEQ ID NO: 219101 - DNA, 25 bp, E. coli
tggcgagctgaacccggaacaactg

SEQ ID NO: 219102 - DNA, 25 bp, E. coli
tggcgagctgaagccggaacaactg

SEQ ID NO: 219103 - DNA, 25 bp, E. coli
caactgccattgtaacggatcccgg

SEQ ID NO: 219104 - DNA, 25 bp, E. coli
caactgccattgaaacggatcccgg

SEQ ID NO: 219105 - DNA, 25 bp, E. coli
tactcacaccggctattgcgctgct

SEQ ID NO: 219106 - DNA, 25 bp, E. coli
tactcacaccgggtattgcgctgct

SEQ ID NO: 219107 - DNA, 25 bp, E. coli
tatgcctgtgccgtgattgtgctcg

SEQ ID NO: 219108 - DNA, 25 bp, E. coli
tatgcctgtgccctgattgtgctcg

SEQ ID NO: 219109 - DNA, 25 bp, E. coli
tatattgtggcgatgagctactgcg

SEQ ID NO: 219110 - DNA, 25 bp, E. coli
tatattgtggcgttgagctactgcg

SEQ ID NO: 219111 - DNA, 25 bp, E. coli
ttgcgccaacgctcaggaaaaaccg

SEQ ID NO: 219112 - DNA, 25 bp, E. coli
ttgcgccaacgcacaggaaaaaccg

SEQ ID NO: 219113 - DNA, 25 bp, E. coli
ttatgacgttgaagggctacaggcg

SEQ ID NO: 219114 - DNA, 25 bp, E. coli
ttatgacgttgatgggctacaggcg

SEQ ID NO: 219115 - DNA, 25 bp, E. coli
tcgaagcgttactggtgccattgcc

SEQ ID NO: 219116 - DNA, 25 bp, E. coli
tcgaagcgttacaggtgccattgcc

SEQ ID NO: 219117 - DNA, 25 bp, E. coli
tcatcaacgatggtggtggcgctgt

SEQ ID NO: 219118 - DNA, 25 bp, E. coli
tcatcaacgatgctggtggcgctgt

SEQ ID NO: 219119 - DNA, 25 bp, E. coli
gatacgcgatcttttgcaggcaaaa

SEQ ID NO: 219120 - DNA, 25 bp, E. coli
gatacgcgatctattgcaggcaaaa

SEQ ID NO: 219121 - DNA, 25 bp, E. coli
ggctacaggcgaagggtactcacac

SEQ ID NO: 219122 - DNA, 25 bp, E. coli
ggcattcaggaatacagcaacagga

SEQ ID NO: 219123 - DNA, 25 bp, E. coli
ggctacaggcgatgggtactcacac

SEQ ID NO: 219124 - DNA, 25 bp, E. coli
ggcattcaggaaaacagcaacagga

SEQ ID NO: 219125 - DNA, 25 bp, E. coli
taaaaattccgggagcatgggaccc

SEQ ID NO: 219126 - DNA, 25 bp, E. coli
taaaaattccggcagcatgggaccc

SEQ ID NO: 219127 - DNA, 25 bp, E. coli
tatgggcacctgttctggcaacgat

SEQ ID NO: 219128 - DNA, 25 bp, E. coli
tatgggcacctgatctggcaacgat

SEQ ID NO: 219129 - DNA, 25 bp, E. coli
ttgccagccggtttaatgtctacac

SEQ ID NO: 219130 - DNA, 25 bp, E. coli
ttaaacgtacccttgcagaagcagc

SEQ ID NO: 219131 - DNA, 25 bp, E. coli
ttgccagccggtataatgtctacac

SEQ ID NO: 219132 - DNA, 25 bp, E. coli
ttaaacgtacccatgcagaagcagc

SEQ ID NO: 219133 - DNA, 25 bp, E. coli
tgggttattttagcggcagacgaga

SEQ ID NO: 219134 - DNA, 25 bp, E. coli
tgggttattttaccggcagacgaga

SEQ ID NO: 219135 - DNA, 25 bp, E. coli
tgaagctgattcagatgccactggc

SEQ ID NO: 219136 - DNA, 25 bp, E. coli
tgaagctgattctgatgccactggc

SEQ ID NO: 219137 - DNA, 25 bp, E. coli
gcatgggacccaacctttaatctga

SEQ ID NO: 219138 - DNA, 25 bp, E. coli
gcatgggacccatcctttaatctga

SEQ ID NO: 219139 - DNA, 25 bp, E. coli
gactctggctgcacataaattcgag

SEQ ID NO: 219140 - DNA, 25 bp, E. coli
gactctggctgctcataaattcgag

SEQ ID NO: 219141 - DNA, 25 bp, E. coli
gggaaatgatttttgcggacactcg

SEQ ID NO: 219142 - DNA, 25 bp, E. coli
gggaaatgatttatgcggacactcg

SEQ ID NO: 219143 - DNA, 25 bp, E. coli
taatttctgcgggaaaggagccagt

SEQ ID NO: 219144 - DNA, 25 bp, E. coli
taatttctgcggcaaaggagccagt

SEQ ID NO: 219145 - DNA, 25 bp, E. coli
taatctgattgccaaggctaactca

SEQ ID NO: 219146 - DNA, 25 bp, E. coli
taatctgattgcgaaggctaactca

SEQ ID NO: 219147 - DNA, 25 bp, E. coli
acccatcctgatccgcaatttgctg

SEQ ID NO: 219148 - DNA, 25 bp, E. coli
acccatcctgatgcgcaatttgctg

SEQ ID NO: 219149 - DNA, 25 bp, E. coli
ttggtcaacgagagaggacacgccg

SEQ ID NO: 219150 - DNA, 25 bp, E. coli
ttggtcaacgagtgaggacacgccg

SEQ ID NO: 219151 - DNA, 25 bp, E. coli
tgctggaatctcacctgcgaatgcc

SEQ ID NO: 219152 - DNA, 25 bp, E. coli
tgctggaatctctcctgcgaatgcc

SEQ ID NO: 219153 - DNA, 25 bp, E. coli
tgcccggatgctggaatctcacctg

SEQ ID NO: 219154 - DNA, 25 bp, E. coli
tgcccggatgctcgaatctcacctg

SEQ ID NO: 219155 - DNA, 25 bp, E. coli
tcacctgcgaatgccggtaaatacc

SEQ ID NO: 219156 - DNA, 25 bp, E. coli
cggtaattggtctacgagtgaggac

SEQ ID NO: 219157 - DNA, 25 bp, E. coli
cggatgctggaatctcacctgcgaa

SEQ ID NO: 219158 - DNA, 25 bp, E. coli
cggtaaatacccatcctgatgcgca

SEQ ID NO: 219159 - DNA, 25 bp, E. coli
cggtaattggtcaacgagtgaggac

SEQ ID NO: 219160 - DNA, 25 bp, E. coli
cggatgctggaaactcacctgcgaa

SEQ ID NO: 219161 - DNA, 25 bp, E. coli
cggtaaatacccttcctgatgcgca

SEQ ID NO: 219162 - DNA, 25 bp, E. coli
gtttgcccggatgctggaatctcac

SEQ ID NO: 219163 - DNA, 25 bp, E. coli
gtttgcccggatcctggaatctcac

SEQ ID NO: 219164 - DNA, 25 bp, E. coli
ggaatctcacctccgaatgccggta

SEQ ID NO: 219165 - DNA, 25 bp, E. coli
ggaatctcacctgcgaatgccggta

SEQ ID NO: 219166 - DNA, 25 bp, E. coli
tcaacgagtgaggacacgccgatga

SEQ ID NO: 219167 - DNA, 25 bp, E. coli
tcacctgcgaatcccggtaaatacc

SEQ ID NO: 219168 - DNA, 25 bp, E. coli
tcaacgagtgagcacacgccgatga

SEQ ID NO: 219169 - DNA, 25 bp, E. coli
caagcagggtaacgaattcggcgca

SEQ ID NO: 219170 - DNA, 25 bp, E. coli
caagcagggtaaggaattcggcgca

SEQ ID NO: 219171 - DNA, 25 bp, E. coli
taaatatgttgttcgctaccagggc

SEQ ID NO: 219172 - DNA, 25 bp, E. coli
taaatatgttgtacgctaccagggc

SEQ ID NO: 219173 - DNA, 25 bp, E. coli
taaactggacgttctggatggcctg

SEQ ID NO: 219174 - DNA, 25 bp, E. coli
taaactggacgtactggatggcctg

SEQ ID NO: 219175 - DNA, 25 bp, E. coli
tattccatcaggtattctccgcgag

SEQ ID NO: 219176 - DNA, 25 bp, E. coli
tattccatcaggaattctccgcgag

SEQ ID NO: 219177 - DNA, 25 bp, E. coli
tgaaaccatgatactgcgcgacccg

SEQ ID NO: 219178 - DNA, 25 bp, E. coli
tgaaaccatgattctgcgcgacccg

SEQ ID NO: 219179 - DNA, 25 bp, E. coli
tcgatatcatctctaccggtccgga

SEQ ID NO: 219180 - DNA, 25 bp, E. coli
tcgatatcatctgtaccggtccgga

SEQ ID NO: 219181 - DNA, 25 bp, E. coli
tctggatgataccatggctgttgcc

SEQ ID NO: 219182 - DNA, 25 bp, E. coli
tctggatgatacgatggctgttgcc

SEQ ID NO: 219183 - DNA, 25 bp, E. coli
cctgggcccgcgatatgttgattac

SEQ ID NO: 219184 - DNA, 25 bp, E. coli
cctgggcccgcgttatgttgattac

SEQ ID NO: 219185 - DNA, 25 bp, E. coli
cgatcttctgactgaacgggctaaa

SEQ ID NO: 219186 - DNA, 25 bp, E. coli
cgatcttctgacagaacgggctaaa

SEQ ID NO: 219187 - DNA, 25 bp, E. coli
gatttacgaaacgatgccgggctgg

SEQ ID NO: 219188 - DNA, 25 bp, E. coli
gatttacgaaaccatgccgggctgg

SEQ ID NO: 219189 - DNA, 25 bp, E. coli
ggtctgaatccaccttcggcgtgaa

SEQ ID NO: 219190 - DNA, 25 bp, E. coli
ggtctgaatccagcttcggcgtgaa

SEQ ID NO: 219191 - DNA, 25 bp, E. coli
caatgtgcctggaacatggcgggcc

SEQ ID NO: 219192 - DNA, 25 bp, E. coli
caatgtgcctggtacatggcgggcc

SEQ ID NO: 219193 - DNA, 25 bp, E. coli
catcggattgacgagctgtatagcg

SEQ ID NO: 219194 - DNA, 25 bp, E. coli
catcggattgaccagctgtatagcg

SEQ ID NO: 219195 - DNA, 25 bp, E. coli
taaaacaggcgggtatcacctggag

SEQ ID NO: 219196 - DNA, 25 bp, E. coli
taaaacaggcggctatcacctggag

SEQ ID NO: 219197 - DNA, 25 bp, E. coli
tagttgccagtatacagtcggcccc

SEQ ID NO: 219198 - DNA, 25 bp, E. coli
tagttgccagtaaacagtcggcccc

SEQ ID NO: 219199 - DNA, 25 bp, E. coli
tatagcgttcagtgttcaggccgca

SEQ ID NO: 219200 - DNA, 25 bp, E. coli
tatagcgttcagagttcaggccgca

SEQ ID NO: 219201 - DNA, 25 bp, E. coli
tgattaccacagtcagcagatggcg

SEQ ID NO: 219202 - DNA, 25 bp, E. coli
tgattaccacagacagcagatggcg

SEQ ID NO: 219203 - DNA, 25 bp, E. coli
tctggcgtcaacgaaatcgatggca

SEQ ID NO: 219204 - DNA, 25 bp, E. coli
tctggcgtcaaccaaatcgatggca

SEQ ID NO: 219205 - DNA, 25 bp, E. coli
gatttggtgccgttccgacgttaaa

SEQ ID NO: 219206 - DNA, 25 bp, E. coli
gatttggtgccgatccgacgttaaa

SEQ ID NO: 219207 - DNA, 25 bp, E. coli
ggattcattacctcagcgagcgggc

SEQ ID NO: 219208 - DNA, 25 bp, E. coli
ggatgcctgccagaacgttctgagc

SEQ ID NO: 219209 - DNA, 25 bp, E. coli
tggaaaagtctcagcgaaaaccggt

SEQ ID NO: 219210 - DNA, 25 bp, E. coli
ggatgcctgccacaacgttctgagc

SEQ ID NO: 219211 - DNA, 25 bp, E. coli
ggattcattaccacagcgagcgggc

SEQ ID NO: 219212 - DNA, 25 bp, E. coli
tggaaaagtctctgcgaaaaccggt

SEQ ID NO: 219213 - DNA, 25 bp, E. coli
caactggcgcgttatcttgagctca

SEQ ID NO: 219214 - DNA, 25 bp, E. coli
caacctgctgatgaagaacgcgtca

SEQ ID NO: 219215 - DNA, 25 bp, E. coli
caactggcgcgtaatcttgagctca

SEQ ID NO: 219216 - DNA, 25 bp, E. coli
caacctgctgatcaagaacgcgtca

SEQ ID NO: 219217 - DNA, 25 bp, E. coli
tatgagcactggtatcagcagccga

SEQ ID NO: 219218 - DNA, 25 bp, E. coli
tagaattgctgtatccctggccctg

SEQ ID NO: 219219 - DNA, 25 bp, E. coli
tatgagcactggaatcagcagccga

SEQ ID NO: 219220 - DNA, 25 bp, E. coli
tagaattgctgtttccctggccctg

SEQ ID NO: 219221 - DNA, 25 bp, E. coli
ttgaatcagaactggcccaggcact

SEQ ID NO: 219222 - DNA, 25 bp, E. coli
ttgaatcagaacaggcccaggcact

SEQ ID NO: 219223 - DNA, 25 bp, E. coli
gctatacctggaacagcgcctggct

SEQ ID NO: 219224 - DNA, 25 bp, E. coli
gctatacctggatcagcgcctggct

SEQ ID NO: 219225 - DNA, 25 bp, E. coli
gactggcgggacgtttgcgtaacct

SEQ ID NO: 219226 - DNA, 25 bp, E. coli
gactggcgggacctttgcgtaacct

SEQ ID NO: 219227 - DNA, 25 bp, E. coli
cggtctgggtcatcgctatgcaaca

SEQ ID NO: 219228 - DNA, 25 bp, E. coli
cggtctgggtcaacgctatgcaaca

SEQ ID NO: 219229 - DNA, 25 bp, E. coli
gtatcaaatatgtccagcgagccga

SEQ ID NO: 219230 - DNA, 25 bp, E. coli
gtatcaaatatgaccagcgagccga

SEQ ID NO: 219231 - DNA, 25 bp, E. coli
ggtgccgtctggtacaacgtcctga

SEQ ID NO: 219232 - DNA, 25 bp, E. coli
ggtgccgtctggaacaacgtcctga

SEQ ID NO: 219233 - DNA, 25 bp, E. coli
gatgcagcaacttgaaccacgggca

SEQ ID NO: 219234 - DNA, 25 bp, E. coli
gatgcagcaactagaaccacgggca

SEQ ID NO: 219235 - DNA, 25 bp, E. coli
aatgaagaggatactccatgtctgg

SEQ ID NO: 219236 - DNA, 25 bp, E. coli
aatgaagaggattctccatgtctgg

SEQ ID NO: 219237 - DNA, 25 bp, E. coli
aaatataagtgtccagccagagcgg

SEQ ID NO: 219238 - DNA, 25 bp, E. coli
aaatataagtgtgcagccagagcgg

SEQ ID NO: 219239 - DNA, 25 bp, E. coli
ttagagtgtcctagccgggcagagc

SEQ ID NO: 219240 - DNA, 25 bp, E. coli
tatgctcctgtacatggcgatggat

SEQ ID NO: 219241 - DNA, 25 bp, E. coli
tatgctcctgtagatggcgatggat

SEQ ID NO: 219242 - DNA, 25 bp, E. coli
ttagagtgtccttgccgggcagagc

SEQ ID NO: 219243 - DNA, 25 bp, E. coli
tgcggttatacaatgaactcagacg

SEQ ID NO: 219244 - DNA, 25 bp, E. coli
tgcggttatacattgaactcagacg

SEQ ID NO: 219245 - DNA, 25 bp, E. coli
ccatgtctggaaagtgaatcactag

SEQ ID NO: 219246 - DNA, 25 bp, E. coli
ccatgtctggaatgtgaatcactag

SEQ ID NO: 219247 - DNA, 25 bp, E. coli
gcttgctttagaaaccgacacgtcg

SEQ ID NO: 219248 - DNA, 25 bp, E. coli
gcttgctttagataccgacacgtcg

SEQ ID NO: 219249 - DNA, 25 bp, E. coli
gcgtgaaactaaccaggcattagga

SEQ ID NO: 219250 - DNA, 25 bp, E. coli
gcgtgaaactaagcaggcattagga

SEQ ID NO: 219251 - DNA, 25 bp, E. coli
gacacgtcggataggattaaagcgg

SEQ ID NO: 219252 - DNA, 25 bp, E. coli
gacacgtcggattggattaaagcgg

SEQ ID NO: 219253 - DNA, 25 bp, E. coli
ggcgctggtcagttataagatgcaa

SEQ ID NO: 219254 - DNA, 25 bp, E. coli
ggcgctggtcagatataagatgcaa

SEQ ID NO: 219255 - DNA, 25 bp, E. coli
taaggaaatgaaagcgcaactcgac

SEQ ID NO: 219256 - DNA, 25 bp, E. coli
taaggaaatgaatgcgcaactcgac

SEQ ID NO: 219257 - DNA, 25 bp, E. coli
aatttccccggatgtgcaggacgct

SEQ ID NO: 219258 - DNA, 25 bp, E. coli
aacgatgattatagcggcgcttgcc

SEQ ID NO: 219259 - DNA, 25 bp, E. coli
aatttccccggaagtgcaggacgct

SEQ ID NO: 219260 - DNA, 25 bp, E. coli
caaagaatatcaccgtctcgcgggt

SEQ ID NO: 219261 - DNA, 25 bp, E. coli
caaagaatatcagcgtctcgcgggt

SEQ ID NO: 219262 - DNA, 25 bp, E. coli
aaaaccggttgtcgcgctggaatcg

SEQ ID NO: 219263 - DNA, 25 bp, E. coli
aaaaccggttgtggcgctggaatcg

SEQ ID NO: 219264 - DNA, 25 bp, E. coli
aacgatgattattgcggcgcttgcc

SEQ ID NO: 219265 - DNA, 25 bp, E. coli
tatcagactaaaccgctgcctgcgt

SEQ ID NO: 219266 - DNA, 25 bp, E. coli
tatcagactaaagcgctgcctgcgt

SEQ ID NO: 219267 - DNA, 25 bp, E. coli
tatttagaaaccatcggtgtgccgt

SEQ ID NO: 219268 - DNA, 25 bp, E. coli
tatttagaaaccttcggtgtgccgt

SEQ ID NO: 219269 - DNA, 25 bp, E. coli
gaagaaactattcgtaaacagggcg

SEQ ID NO: 219270 - DNA, 25 bp, E. coli
gaagaaactattggtaaacagggcg

SEQ ID NO: 219271 - DNA, 25 bp, E. coli
tggtaaagaaagtacgccattcctg

SEQ ID NO: 219272 - DNA, 25 bp, E. coli
tggtaaagaaagaacgccattcctg

SEQ ID NO: 219273 - DNA, 25 bp, E. coli
taatgtcaccgtagtttgtgccggg

SEQ ID NO: 219274 - DNA, 25 bp, E. coli
taatgtcaccgttgtttgtgccggg

SEQ ID NO: 219275 - DNA, 25 bp, E. coli
gaccattatttcacacgggatgccg

SEQ ID NO: 219276 - DNA, 25 bp, E. coli
tagcgaacccgaacccggaacagtt

SEQ ID NO: 219277 - DNA, 25 bp, E. coli
tagcgaacccgatcccggaacagtt

SEQ ID NO: 219278 - DNA, 25 bp, E. coli
gaccattatttctcacgggatgccg

SEQ ID NO: 219279 - DNA, 25 bp, E. coli
cacgttgtgacgcagagtatctcag

SEQ ID NO: 219280 - DNA, 25 bp, E. coli
cacgttgtgacggagagtatctcag

SEQ ID NO: 219281 - DNA, 25 bp, E. coli
cagaatttacctacgcgagagcaga

SEQ ID NO: 219282 - DNA, 25 bp, E. coli
cagaatttaccttcgcgagagcaga

SEQ ID NO: 219283 - DNA, 25 bp, E. coli
aaagcattagttgatatcgtgcgcc

SEQ ID NO: 219284 - DNA, 25 bp, E. coli
aaagcattagttcatatcgtgcgcc

SEQ ID NO: 219285 - DNA, 25 bp, E. coli
tatcgctactgtaccaaagcgcggc

SEQ ID NO: 219286 - DNA, 25 bp, E. coli
tatcagctctctaacgcgataggcg

SEQ ID NO: 219287 - DNA, 25 bp, E. coli
tatcaaaagcgtaaaaccaaccgtg

SEQ ID NO: 219288 - DNA, 25 bp, E. coli
tatcaaaagcgttaaaccaaccgtg

SEQ ID NO: 219289 - DNA, 25 bp, E. coli
tatatcaaataatagcggtcagtgc

SEQ ID NO: 219290 - DNA, 25 bp, E. coli
tatcgctactgttccaaagcgcggc

SEQ ID NO: 219291 - DNA, 25 bp, E. coli
tatcagctctcttacgcgataggcg

SEQ ID NO: 219292 - DNA, 25 bp, E. coli
tatatcaaataaaagcggtcagtgc

SEQ ID NO: 219293 - DNA, 25 bp, E. coli
gttttctttgctgaacacagtggcg

SEQ ID NO: 219294 - DNA, 25 bp, E. coli
gttttctttgctcaacacagtggcg

SEQ ID NO: 219295 - DNA, 25 bp, E. coli
tcactaacggtattcagctggcgat

SEQ ID NO: 219296 - DNA, 25 bp, E. coli
taaaccaaattagccgcaatgggcg

SEQ ID NO: 219297 - DNA, 25 bp, E. coli
taaaccaaattacccgcaatgggcg

SEQ ID NO: 219298 - DNA, 25 bp, E. coli
taatggtgccggttatctggtacag

SEQ ID NO: 219299 - DNA, 25 bp, E. coli
tcactaacggtaatcagctggcgat

SEQ ID NO: 219300 - DNA, 25 bp, E. coli
taatggtgccggatatctggtacag

SEQ ID NO: 219301 - DNA, 25 bp, E. coli
caatgtgccagcgttaacgttgaca

SEQ ID NO: 219302 - DNA, 25 bp, E. coli
caatgtgccagccttaacgttgaca

SEQ ID NO: 219303 - DNA, 25 bp, E. coli
caaatagcaagagaaagcagcggca

SEQ ID NO: 219304 - DNA, 25 bp, E. coli
caaatagcaagacaaagcagcggca

SEQ ID NO: 219305 - DNA, 25 bp, E. coli
aaagattactgtgctcctggagtca

SEQ ID NO: 219306 - DNA, 25 bp, E. coli
aaagattactgtcctcctggagtca

SEQ ID NO: 219307 - DNA, 25 bp, E. coli
tatggatacatgtcgaggactcggc

SEQ ID NO: 219308 - DNA, 25 bp, E. coli
tatggaatccaacgtacagtcgtag

SEQ ID NO: 219309 - DNA, 25 bp, E. coli
tatgccatccagaagcagcaacggc

SEQ ID NO: 219310 - DNA, 25 bp, E. coli
tatggatacatgacgaggactcggc

SEQ ID NO: 219311 - DNA, 25 bp, E. coli
tatgccatccagtagcagcaacggc

SEQ ID NO: 219312 - DNA, 25 bp, E. coli
tatggaatccaaggtacagtcgtag

SEQ ID NO: 219313 - DNA, 25 bp, E. coli
tgttgaagccgagattcgcacagca

SEQ ID NO: 219314 - DNA, 25 bp, E. coli
tgttgaagccgacattcgcacagca

SEQ ID NO: 219315 - DNA, 25 bp, E. coli
tgagatggacctcactgatactacc

SEQ ID NO: 219316 - DNA, 25 bp, E. coli
tgagatggacctgactgatactacc

SEQ ID NO: 219317 - DNA, 25 bp, E. coli
tgctcaaacagaaccgctttccggg

SEQ ID NO: 219318 - DNA, 25 bp, E. coli
tgctcaaacagatccgctttccggg

SEQ ID NO: 219319 - DNA, 25 bp, E. coli
gcttcgcgatgcactaggacttaaa

SEQ ID NO: 219320 - DNA, 25 bp, E. coli
gcttcgcgatgctctaggacttaaa

SEQ ID NO: 219321 - DNA, 25 bp, E. coli
taagtgcgctactaccaaggtatgc

SEQ ID NO: 219322 - DNA, 25 bp, E. coli
taagtgcgctacaaccaaggtatgc

SEQ ID NO: 219323 - DNA, 25 bp, E. coli
caaagtccggcaatgcactacggtc

SEQ ID NO: 219324 - DNA, 25 bp, E. coli
caaagtccggcattgcactacggtc

SEQ ID NO: 219325 - DNA, 25 bp, E. coli
cagaactatctaggaaaaaacaggg

SEQ ID NO: 219326 - DNA, 25 bp, E. coli
cagaactatctacgaaaaaacaggg

SEQ ID NO: 219327 - DNA, 25 bp, E. coli
acaaatggctatagaaggcgctgcg

SEQ ID NO: 219328 - DNA, 25 bp, E. coli
acaaatggctattgaaggcgctgcg

SEQ ID NO: 219329 - DNA, 25 bp, E. coli
tccgtgccgttcacaagatgaattg

SEQ ID NO: 219330 - DNA, 25 bp, E. coli
tccgtgccgttctcaagatgaattg

SEQ ID NO: 219331 - DNA, 25 bp, E. coli
tcgctgctggtaaaacaaagtccgg

SEQ ID NO: 219332 - DNA, 25 bp, E. coli
tcggtttgctgtgaggtgcttatgc

SEQ ID NO: 219333 - DNA, 25 bp, E. coli
tcggtttgctgtcaggtgcttatgc

SEQ ID NO: 219334 - DNA, 25 bp, E. coli
tcgctgctggtataacaaagtccgg

SEQ ID NO: 219335 - DNA, 25 bp, E. coli
gcttatgctgaccaaagaaccatca

SEQ ID NO: 219336 - DNA, 25 bp, E. coli
gcttatgctgacgaaagaaccatca

SEQ ID NO: 219337 - DNA, 25 bp, E. coli
gcactacggtcagggctggatcatg

SEQ ID NO: 219338 - DNA, 25 bp, E. coli
gcactacggtcacggctggatcatg

SEQ ID NO: 219339 - DNA, 25 bp, E. coli
gaaccatcatttccatcgctgctgg

SEQ ID NO: 219340 - DNA, 25 bp, E. coli
gaaccatcatttgcatcgctgctgg

SEQ ID NO: 219341 - DNA, 25 bp, E. coli
ggcgctgcggcgtctgttccattaa

SEQ ID NO: 219342 - DNA, 25 bp, E. coli
ggcgctgcggcgactgttccattaa

SEQ ID NO: 219343 - DNA, 25 bp, E. coli
gatggtaaacgcaggcatccgtgcc

SEQ ID NO: 219344 - DNA, 25 bp, E. coli
gatggtaaacgctggcatccgtgcc

SEQ ID NO: 219345 - DNA, 25 bp, E. coli
aagaaagcagcacaactcaggcggg

SEQ ID NO: 219346 - DNA, 25 bp, E. coli
aagcagcacaactcaggcgggtgta

SEQ ID NO: 219347 - DNA, 25 bp, E. coli
aagcagcacaacacaggcgggtgta

SEQ ID NO: 219348 - DNA, 25 bp, E. coli
aagaaagcagcagaactcaggcggg

SEQ ID NO: 219349 - DNA, 25 bp, E. coli
cagcacaactcaggcgggtgtagtc

SEQ ID NO: 219350 - DNA, 25 bp, E. coli
cagcacaactcacgcgggtgtagtc

SEQ ID NO: 219351 - DNA, 25 bp, E. coli
aggcgctggcttagagcaaacattg

SEQ ID NO: 219352 - DNA, 25 bp, E. coli
agaaagcagcacaactcaggcgggt

SEQ ID NO: 219353 - DNA, 25 bp, E. coli
aggcgctggctttgagcaaacattg

SEQ ID NO: 219354 - DNA, 25 bp, E. coli
agaaagcagcactactcaggcgggt

SEQ ID NO: 219355 - DNA, 25 bp, E. coli
acattgacggggctaacgcttggta

SEQ ID NO: 219356 - DNA, 25 bp, E. coli
acaactcaggcgcgtgtagtctgga

SEQ ID NO: 219357 - DNA, 25 bp, E. coli
acattgacgggggtaacgcttggta

SEQ ID NO: 219358 - DNA, 25 bp, E. coli
acaactcaggcgggtgtagtctgga

SEQ ID NO: 219359 - DNA, 25 bp, E. coli
aacgcttggtatcgacagccgtttc

SEQ ID NO: 219360 - DNA, 25 bp, E. coli
aacgcttggtatggacagccgtttc

SEQ ID NO: 219361 - DNA, 25 bp, E. coli
tgatgcaggcgctggctttgagcaa

SEQ ID NO: 219362 - DNA, 25 bp, E. coli
tgcaggcgctgggtttgagcaaaca

SEQ ID NO: 219363 - DNA, 25 bp, E. coli
tgatgcaggcgcaggctttgagcaa

SEQ ID NO: 219364 - DNA, 25 bp, E. coli
tgcaggcgctggctttgagcaaaca

SEQ ID NO: 219365 - DNA, 25 bp, E. coli
gctaacgcttggaatcgacagccgt

SEQ ID NO: 219366 - DNA, 25 bp, E. coli
gctaacgcttggtatcgacagccgt

SEQ ID NO: 219367 - DNA, 25 bp, E. coli
cagctcaaggcgctattcgttaaca

SEQ ID NO: 219368 - DNA, 25 bp, E. coli
cagcgccgccatgttgtaccaggtt

SEQ ID NO: 219369 - DNA, 25 bp, E. coli
cagcgccgccatcttgtaccaggtt

SEQ ID NO: 219370 - DNA, 25 bp, E. coli
cagctcaaggcggtattcgttaaca

SEQ ID NO: 219371 - DNA, 25 bp, E. coli
cagtcccgcagaaggctgttttacg

SEQ ID NO: 219372 - DNA, 25 bp, E. coli
cagtcccgcagatggctgttttacg

SEQ ID NO: 219373 - DNA, 25 bp, E. coli
caggaacgtcggtcatccagatgcc

SEQ ID NO: 219374 - DNA, 25 bp, E. coli
caggaacgtcggacatccagatgcc

SEQ ID NO: 219375 - DNA, 25 bp, E. coli
catagcgtcaaagcccttctggaaa

SEQ ID NO: 219376 - DNA, 25 bp, E. coli
catagcgtcaaaccccttctggaaa

SEQ ID NO: 219377 - DNA, 25 bp, E. coli
agatcgaggccacactgaatcagcg

SEQ ID NO: 219378 - DNA, 25 bp, E. coli
agatcgaggccagactgaatcagcg

SEQ ID NO: 219379 - DNA, 25 bp, E. coli
tatagatgtgaaggtcagtcccgca

SEQ ID NO: 219380 - DNA, 25 bp, E. coli
tatagatgtgaacgtcagtcccgca

SEQ ID NO: 219381 - DNA, 25 bp, E. coli
tgatatggccttcgccagaaacgcg

SEQ ID NO: 219382 - DNA, 25 bp, E. coli
tgatatggccttggccagaaacgcg

SEQ ID NO: 219383 - DNA, 25 bp, E. coli
tcagaataactttcccggactggcc

SEQ ID NO: 219384 - DNA, 25 bp, E. coli
tcagaataacttacccggactggcc

SEQ ID NO: 219385 - DNA, 25 bp, E. coli
cattgcgtgcacgaacgtgtttcgc

SEQ ID NO: 219386 - DNA, 25 bp, E. coli
cattgcgtgcaccaacgtgtttcgc

SEQ ID NO: 219387 - DNA, 25 bp, E. coli
taatcagcagatcgttatgcccgag

SEQ ID NO: 219388 - DNA, 25 bp, E. coli
taatcagcagatggttatgcccgag

SEQ ID NO: 219389 - DNA, 25 bp, E. coli
cagaaagccgcaatcttgctgtttc

SEQ ID NO: 219390 - DNA, 25 bp, E. coli
cagaaagccgcattcttgctgtttc

SEQ ID NO: 219391 - DNA, 25 bp, E. coli
ttaaatgccgccctcgcgctgaaaa

SEQ ID NO: 219392 - DNA, 25 bp, E. coli
ttaaatgccgccgtcgcgctgaaaa

SEQ ID NO: 219393 - DNA, 25 bp, E. coli
tgaaaaccactcttgcccctgaaga

SEQ ID NO: 219394 - DNA, 25 bp, E. coli
tgaaaaccactcatgcccctgaaga

SEQ ID NO: 219395 - DNA, 25 bp, E. coli
cctgatggcttaacattagttgaag

SEQ ID NO: 219396 - DNA, 25 bp, E. coli
cctgatggcttatcattagttgaag

SEQ ID NO: 219397 - DNA, 25 bp, E. coli
ccggaattggtatttcctgatggct

SEQ ID NO: 219398 - DNA, 25 bp, E. coli
ccggaattggtaattcctgatggct

SEQ ID NO: 219399 - DNA, 25 bp, E. coli
gctctacaggcaaaaggctttaatg

SEQ ID NO: 219400 - DNA, 25 bp, E. coli
gctctacaggcataaggctttaatg

SEQ ID NO: 219401 - DNA, 25 bp, E. coli
gaaattgcgccgcaattggtatttc

SEQ ID NO: 219402 - DNA, 25 bp, E. coli
gaaattgcgccggaattggtatttc

SEQ ID NO: 219403 - DNA, 25 bp, E. coli
cgattacttaaaagccgccgtcgcg

SEQ ID NO: 219404 - DNA, 25 bp, E. coli
cgattacttaaatgccgccgtcgcg

SEQ ID NO: 219405 - DNA, 25 bp, E. coli
cattaggcgatattccagaaagccg

SEQ ID NO: 219406 - DNA, 25 bp, E. coli
cattagttgaaggtctacaggcaaa

SEQ ID NO: 219407 - DNA, 25 bp, E. coli
cattagttgaagctctacaggcaaa

SEQ ID NO: 219408 - DNA, 25 bp, E. coli
cattaggcgataatccagaaagccg

SEQ ID NO: 219409 - DNA, 25 bp, E. coli
taataaataccgaacgtctgaccgt

SEQ ID NO: 219410 - DNA, 25 bp, E. coli
taataaataccgtacgtctgaccgt

SEQ ID NO: 219411 - DNA, 25 bp, E. coli
cacagaggtctactttttcgcgaaa

SEQ ID NO: 219412 - DNA, 25 bp, E. coli
cacagaggtctagtttttcgcgaaa

SEQ ID NO: 219413 - DNA, 25 bp, E. coli
caggcttcctacttacagaattgag

SEQ ID NO: 219414 - DNA, 25 bp, E. coli
caggcctgccgcttaaccaatcagg

SEQ ID NO: 219415 - DNA, 25 bp, E. coli
caggcttcctacatacagaattgag

SEQ ID NO: 219416 - DNA, 25 bp, E. coli
caggcctgccgcataaccaatcagg

SEQ ID NO: 219417 - DNA, 25 bp, E. coli
atcccattgggtcgtcatgttctgc

SEQ ID NO: 219418 - DNA, 25 bp, E. coli
atcccattgggtggtcatgttctgc

SEQ ID NO: 219419 - DNA, 25 bp, E. coli
aaagatgtgttccatgctgtgtacc

SEQ ID NO: 219420 - DNA, 25 bp, E. coli
aaagatgtgttcgatgctgtgtacc

SEQ ID NO: 219421 - DNA, 25 bp, E. coli
taccgcccaacgaaaagcatgaaag

SEQ ID NO: 219422 - DNA, 25 bp, E. coli
taccgcccaacgtaaagcatgaaag

SEQ ID NO: 219423 - DNA, 25 bp, E. coli
ttttcgcgaaaacgtagatctctac

SEQ ID NO: 219424 - DNA, 25 bp, E. coli
ttttcgcgaaaaggtagatctctac

SEQ ID NO: 219425 - DNA, 25 bp, E. coli
ttgagaaaagagcatgtggaaatgc

SEQ ID NO: 219426 - DNA, 25 bp, E. coli
ttgagaaaagaggatgtggaaatgc

SEQ ID NO: 219427 - DNA, 25 bp, E. coli
tgaaagcgatcacgaatcccattgg

SEQ ID NO: 219428 - DNA, 25 bp, E. coli
tgaaagcgatcaggaatcccattgg

SEQ ID NO: 219429 - DNA, 25 bp, E. coli
tgcgcacacaagttctgcttaatcg

SEQ ID NO: 219430 - DNA, 25 bp, E. coli
tgcgcacacaagatctgcttaatcg

SEQ ID NO: 219431 - DNA, 25 bp, E. coli
gctgtgtacctgagctcacagaggt

SEQ ID NO: 219432 - DNA, 25 bp, E. coli
gctgtgtacctgtgctcacagaggt

SEQ ID NO: 219433 - DNA, 25 bp, E. coli
catcttagtgccctgaactggtcaa

SEQ ID NO: 219434 - DNA, 25 bp, E. coli
catcttagtgccgtgaactggtcaa

SEQ ID NO: 219435 - DNA, 25 bp, E. coli
aacttcttgtacttgtctggcggca

SEQ ID NO: 219436 - DNA, 25 bp, E. coli
aacttcttgtacatgtctggcggca

SEQ ID NO: 219437 - DNA, 25 bp, E. coli
tatcagtgtgatggcgctaagcctc

SEQ ID NO: 219438 - DNA, 25 bp, E. coli
tatcagtgtgatcgcgctaagcctc

SEQ ID NO: 219439 - DNA, 25 bp, E. coli
tgtacaaacataaggcgaccctgcg

SEQ ID NO: 219440 - DNA, 25 bp, E. coli
tgtacaaacatatggcgaccctgcg

SEQ ID NO: 219441 - DNA, 25 bp, E. coli
tgtcagcggcgaacaaccggaagat

SEQ ID NO: 219442 - DNA, 25 bp, E. coli
tgtcagcggcgatcaaccggaagat

SEQ ID NO: 219443 - DNA, 25 bp, E. coli
tcgaaacggcggataccagtctgct

SEQ ID NO: 219444 - DNA, 25 bp, E. coli
tcgaaacggcggttaccagtctgct

SEQ ID NO: 219445 - DNA, 25 bp, E. coli
gcctttcaaagctgagtttccgcgc

SEQ ID NO: 219446 - DNA, 25 bp, E. coli
gcctttcaaagcagagtttccgcgc

SEQ ID NO: 219447 - DNA, 25 bp, E. coli
cattctcactatcggttcagcggcg

SEQ ID NO: 219448 - DNA, 25 bp, E. coli
cattgcttttgtgcgtctgccggaa

SEQ ID NO: 219449 - DNA, 25 bp, E. coli
cattgcttttgtccgtctgccggaa

SEQ ID NO: 219450 - DNA, 25 bp, E. coli
cattctcactatgggttcagcggcg

SEQ ID NO: 219451 - DNA, 25 bp, E. coli
tcaatcagcgccatatcgaaacggc

SEQ ID NO: 219452 - DNA, 25 bp, E. coli
tcaatcagcgccttatcgaaacggc

SEQ ID NO: 219453 - DNA, 25 bp, E. coli
gatggcagtcacactcggatcgcaa

SEQ ID NO: 219454 - DNA, 25 bp, E. coli
gatggcagtcactctcggatcgcaa

SEQ ID NO: 219455 - DNA, 25 bp, E. coli
cagatatacctgtcgcaaaccggtt

SEQ ID NO: 219456 - DNA, 25 bp, E. coli
cagatatacctgacgcaaaccggtt

SEQ ID NO: 219457 - DNA, 25 bp, E. coli
aaaaaatccgctggcgaatgcgtcg

SEQ ID NO: 219458 - DNA, 25 bp, E. coli
aaaaaatccgctcgcgaatgcgtcg

SEQ ID NO: 219459 - DNA, 25 bp, E. coli
taagattagaatatgggtgcctgag

SEQ ID NO: 219460 - DNA, 25 bp, E. coli
tcggcaaatctccaatgcagaggca

SEQ ID NO: 219461 - DNA, 25 bp, E. coli
tcaggaagaacagattcggcgcttt

SEQ ID NO: 219462 - DNA, 25 bp, E. coli
tcggcgctttttaggcagatatacc

SEQ ID NO: 219463 - DNA, 25 bp, E. coli
tcggcgcttttttggcagatatacc

SEQ ID NO: 219464 - DNA, 25 bp, E. coli
tcggcaaatctcgaatgcagaggca

SEQ ID NO: 219465 - DNA, 25 bp, E. coli
taagattagaatttgggtgcctgag

SEQ ID NO: 219466 - DNA, 25 bp, E. coli
tcaggaagaacacattcggcgcttt

SEQ ID NO: 219467 - DNA, 25 bp, E. coli
gaatgtattgcacatgtttcccatg

SEQ ID NO: 219468 - DNA, 25 bp, E. coli
gcagaggcaatattttacgagaatc

SEQ ID NO: 219469 - DNA, 25 bp, E. coli
gaatgtgcgtaatgtcaaattcgac

SEQ ID NO: 219470 - DNA, 25 bp, E. coli
gaatgtattgcagatgtttcccatg

SEQ ID NO: 219471 - DNA, 25 bp, E. coli
gcagaggcaataatttacgagaatc

SEQ ID NO: 219472 - DNA, 25 bp, E. coli
gaatgtgcgtaaagtcaaattcgac

SEQ ID NO: 219473 - DNA, 25 bp, E. coli
gaacattgtcatcacatctaccttg

SEQ ID NO: 219474 - DNA, 25 bp, E. coli
gaacattgtcatgacatctaccttg

SEQ ID NO: 219475 - DNA, 25 bp, E. coli
gatggacatctgtaaacggtctgga

SEQ ID NO: 219476 - DNA, 25 bp, E. coli
gatggacatctgaaaacggtctgga

SEQ ID NO: 219477 - DNA, 25 bp, E. coli
catgatttctcctttattacagcgg

SEQ ID NO: 219478 - DNA, 25 bp, E. coli
catgatttctccattattacagcgg

SEQ ID NO: 219479 - DNA, 25 bp, E. coli
tacagcggtaaatagtctggctcat

SEQ ID NO: 219480 - DNA, 25 bp, E. coli
tacagcggtaaaaagtctggctcat

SEQ ID NO: 219481 - DNA, 25 bp, E. coli
tattacagcggttaaaagtctggct

SEQ ID NO: 219482 - DNA, 25 bp, E. coli
tattacagcggtaaaaagtctggct

SEQ ID NO: 219483 - DNA, 25 bp, E. coli
tcgcttttacgtaatccagcgactg

SEQ ID NO: 219484 - DNA, 25 bp, E. coli
tcgcttttacgttatccagcgactg

SEQ ID NO: 219485 - DNA, 25 bp, E. coli
ccagcggcttcgtcgatcgctttta

SEQ ID NO: 219486 - DNA, 25 bp, E. coli
ccagcggcttcgacgatcgctttta

SEQ ID NO: 219487 - DNA, 25 bp, E. coli
ccgtcgcgatagatttgctcatgat

SEQ ID NO: 219488 - DNA, 25 bp, E. coli
gccggtgcatttaccgtcgcgatag

SEQ ID NO: 219489 - DNA, 25 bp, E. coli
gccggtgcattttccgtcgcgatag

SEQ ID NO: 219490 - DNA, 25 bp, E. coli
ccgtcgcgatagttttgctcatgat

SEQ ID NO: 219491 - DNA, 25 bp, E. coli
cgtaaggaccgaaagctgccggtgc

SEQ ID NO: 219492 - DNA, 25 bp, E. coli
cggttgcgaagtggttcagatcttt

SEQ ID NO: 219493 - DNA, 25 bp, E. coli
cggttgcgaagtcgttcagatcttt

SEQ ID NO: 219494 - DNA, 25 bp, E. coli
cgatagttttgctcatgatttctcc

SEQ ID NO: 219495 - DNA, 25 bp, E. coli
cgtaaggaccgatagctgccggtgc

SEQ ID NO: 219496 - DNA, 25 bp, E. coli
cgatagttttgcacatgatttctcc

SEQ ID NO: 219497 - DNA, 25 bp, E. coli
gatagctgccggagcattttccgtc

SEQ ID NO: 219498 - DNA, 25 bp, E. coli
gatagctgccggtgcattttccgtc

SEQ ID NO: 219499 - DNA, 25 bp, E. coli
catcacttcgcgaatggccgcagga

SEQ ID NO: 219500 - DNA, 25 bp, E. coli
catcacttcgcgtatggccgcagga

SEQ ID NO: 219501 - DNA, 25 bp, E. coli
atgtcgcaaaaggtgaacgccgggc

SEQ ID NO: 219502 - DNA, 25 bp, E. coli
atgtcgcaaaagctgaacgccgggc

SEQ ID NO: 219503 - DNA, 25 bp, E. coli
taccgatgtcttcagggcactcaaa

SEQ ID NO: 219504 - DNA, 25 bp, E. coli
taccgatgtcttgagggcactcaaa

SEQ ID NO: 219505 - DNA, 25 bp, E. coli
tattgcgccacctctgcatgctgat

SEQ ID NO: 219506 - DNA, 25 bp, E. coli
tattgcgccaccactgcatgctgat

SEQ ID NO: 219507 - DNA, 25 bp, E. coli
tgtcagccgtcacaacttaccgatg

SEQ ID NO: 219508 - DNA, 25 bp, E. coli
tgtcagccgtcagaacttaccgatg

SEQ ID NO: 219509 - DNA, 25 bp, E. coli
tgcatgctgatgaaccacagcccgt

SEQ ID NO: 219510 - DNA, 25 bp, E. coli
tgcatgctgatgtaccacagcccgt

SEQ ID NO: 219511 - DNA, 25 bp, E. coli
gccgggcaaatgaaccgaccgttct

SEQ ID NO: 219512 - DNA, 25 bp, E. coli
ccattgaacagaaaaggcagcacgt

SEQ ID NO: 219513 - DNA, 25 bp, E. coli
ccattgaacagataaggcagcacgt

SEQ ID NO: 219514 - DNA, 25 bp, E. coli
gccgggcaaatgtaccgaccgttct

SEQ ID NO: 219515 - DNA, 25 bp, E. coli
ccgtcacgaatgagccagtcacgct

SEQ ID NO: 219516 - DNA, 25 bp, E. coli
ccgtcacgaatgtgccagtcacgct

SEQ ID NO: 219517 - DNA, 25 bp, E. coli
gtcacgctcttccttcccggtggag

SEQ ID NO: 219518 - DNA, 25 bp, E. coli
gtcacgctcttcgttcccggtggag

SEQ ID NO: 219519 - DNA, 25 bp, E. coli
ggcgcgccagtggtcttacacgtca

SEQ ID NO: 219520 - DNA, 25 bp, E. coli
ggcgcgccagtgctcttacacgtca

SEQ ID NO: 219521 - DNA, 25 bp, E. coli
taaactttgtatacggcatgggagt

SEQ ID NO: 219522 - DNA, 25 bp, E. coli
taaactttgtattcggcatgggagt

SEQ ID NO: 219523 - DNA, 25 bp, E. coli
tagccatttggcctcatacacagca

SEQ ID NO: 219524 - DNA, 25 bp, E. coli
tagccatttggcgtcatacacagca

SEQ ID NO: 219525 - DNA, 25 bp, E. coli
tatattattcactccaagagagact

SEQ ID NO: 219526 - DNA, 25 bp, E. coli
tatattattcacaccaagagagact

SEQ ID NO: 219527 - DNA, 25 bp, E. coli
tgaaaaattttatccgcatggtcct

SEQ ID NO: 219528 - DNA, 25 bp, E. coli
tgaaaaattttaaccgcatggtcct

SEQ ID NO: 219529 - DNA, 25 bp, E. coli
ccttgaagggtagtcgtagtgaagc

SEQ ID NO: 219530 - DNA, 25 bp, E. coli
ccttgaagggtactcgtagtgaagc

SEQ ID NO: 219531 - DNA, 25 bp, E. coli
gcttgccggaaataagctatagcca

SEQ ID NO: 219532 - DNA, 25 bp, E. coli
gcttgccggaaaaaagctatagcca

SEQ ID NO: 219533 - DNA, 25 bp, E. coli
gcatggtccttatcctgaaaaacaa

SEQ ID NO: 219534 - DNA, 25 bp, E. coli
gaatttatctcattgtggcgcactg

SEQ ID NO: 219535 - DNA, 25 bp, E. coli
gcatggtccttaacctgaaaaacaa

SEQ ID NO: 219536 - DNA, 25 bp, E. coli
gaatttatctcaatgtggcgcactg

SEQ ID NO: 219537 - DNA, 25 bp, E. coli
taatgaaagtgaaggcggttcctgc

SEQ ID NO: 219538 - DNA, 25 bp, E. coli
taatgaaagtgatggcggttcctgc

SEQ ID NO: 219539 - DNA, 25 bp, E. coli
taatgttaaattcagcttgccggaa

SEQ ID NO: 219540 - DNA, 25 bp, E. coli
taatgttaaattgagcttgccggaa

SEQ ID NO: 219541 - DNA, 25 bp, E. coli
taataaaataacatctccggccagc

SEQ ID NO: 219542 - DNA, 25 bp, E. coli
taataaaataacttctccggccagc

SEQ ID NO: 219543 - DNA, 25 bp, E. coli
caatctggcaatcgacgacctgcgc

SEQ ID NO: 219544 - DNA, 25 bp, E. coli
caatctggcaatggacgacctgcgc

SEQ ID NO: 219545 - DNA, 25 bp, E. coli
cattttggatttaacgcctggcgca

SEQ ID NO: 219546 - DNA, 25 bp, E. coli
tactcgcttgtgtgcaacaatctgg

SEQ ID NO: 219547 - DNA, 25 bp, E. coli
tactcgcttgtgagcaacaatctgg

SEQ ID NO: 219548 - DNA, 25 bp, E. coli
tatgcaggcaaccacaaccgtaatt

SEQ ID NO: 219549 - DNA, 25 bp, E. coli
tatgcaggcaacgacaaccgtaatt

SEQ ID NO: 219550 - DNA, 25 bp, E. coli
tattcagaaagtaagcgatcactcc

SEQ ID NO: 219551 - DNA, 25 bp, E. coli
tattcagaaagttagcgatcactcc

SEQ ID NO: 219552 - DNA, 25 bp, E. coli
tgtgtagcattgtgagcacgcctgt

SEQ ID NO: 219553 - DNA, 25 bp, E. coli
tgtgtagcattgagagcacgcctgt

SEQ ID NO: 219554 - DNA, 25 bp, E. coli
tgaaaggagcttattcggcctgggc

SEQ ID NO: 219555 - DNA, 25 bp, E. coli
tgaaaggagctttttcggcctgggc

SEQ ID NO: 219556 - DNA, 25 bp, E. coli
tcttgcgtgtgcacgttgatgcccc

SEQ ID NO: 219557 - DNA, 25 bp, E. coli
tcttgcgtgtgctcgttgatgcccc

SEQ ID NO: 219558 - DNA, 25 bp, E. coli
gcctggcgcatggttaccgtttaac

SEQ ID NO: 219559 - DNA, 25 bp, E. coli
cctgtcgtgcagagcggtgtatcgc

SEQ ID NO: 219560 - DNA, 25 bp, E. coli
cctgtcgtgcagtgcggtgtatcgc

SEQ ID NO: 219561 - DNA, 25 bp, E. coli
gcctggcgcatgcttaccgtttaac

SEQ ID NO: 219562 - DNA, 25 bp, E. coli
cattttggattttacgcctggcgca

SEQ ID NO: 219563 - DNA, 25 bp, E. coli
taacttttcatctggcgcactggct

SEQ ID NO: 219564 - DNA, 25 bp, E. coli
taacttttcatcaggcgcactggct

SEQ ID NO: 219565 - DNA, 25 bp, E. coli
caggctcctcttatgtgatggggaa

SEQ ID NO: 219566 - DNA, 25 bp, E. coli
caggctcctcttttgtgatggggaa

SEQ ID NO: 219567 - DNA, 25 bp, E. coli
catggaaaagatatctctgggacaa

SEQ ID NO: 219568 - DNA, 25 bp, E. coli
catggaaaagatttctctgggacaa

SEQ ID NO: 219569 - DNA, 25 bp, E. coli
tgcactcacgccacatgaagaagcg

SEQ ID NO: 219570 - DNA, 25 bp, E. coli
tgcactcacgcctcatgaagaagcg

SEQ ID NO: 219571 - DNA, 25 bp, E. coli
tctctgggacaacgtgaagagttga

SEQ ID NO: 219572 - DNA, 25 bp, E. coli
tctctgggacaaggtgaagagttga

SEQ ID NO: 219573 - DNA, 25 bp, E. coli
gcctcatgaagaagcggtattatcg

SEQ ID NO: 219574 - DNA, 25 bp, E. coli
gcctcatgaagatgcggtattatcg

SEQ ID NO: 219575 - DNA, 25 bp, E. coli
gaagcggtattaacgaatatcagct

SEQ ID NO: 219576 - DNA, 25 bp, E. coli
gaagcggtattatcgaatatcagct

SEQ ID NO: 219577 - DNA, 25 bp, E. coli
gaaaagatatctctgggacaacgtg

SEQ ID NO: 219578 - DNA, 25 bp, E. coli
gaaaagatatctgtgggacaacgtg

SEQ ID NO: 219579 - DNA, 25 bp, E. coli
gacaacgtgaagtgttgaagagttt

SEQ ID NO: 219580 - DNA, 25 bp, E. coli
gaaaaacatggataagatatctctg

SEQ ID NO: 219581 - DNA, 25 bp, E. coli
gaaaaacatggaaaagatatctctg

SEQ ID NO: 219582 - DNA, 25 bp, E. coli
gacaacgtgaagagttgaagagttt

SEQ ID NO: 219583 - DNA, 25 bp, E. coli
gatatctctgggtcaacgtgaagag

SEQ ID NO: 219584 - DNA, 25 bp, E. coli
gatatctctgggacaacgtgaagag

SEQ ID NO: 219585 - DNA, 25 bp, E. coli
tcacgcctcatgtagaagcggtatt

SEQ ID NO: 219586 - DNA, 25 bp, E. coli
tcacgcctcatgaagaagcggtatt

SEQ ID NO: 219587 - DNA, 25 bp, E. coli
gttaacgccggacaccattccaggg

SEQ ID NO: 219588 - DNA, 25 bp, E. coli
gttaacgccggagaccattccaggg

SEQ ID NO: 219589 - DNA, 25 bp, E. coli
tagcacgctgccagtcgtggaagtt

SEQ ID NO: 219590 - DNA, 25 bp, E. coli
tagcacgctgcctgtcgtggaagtt

SEQ ID NO: 219591 - DNA, 25 bp, E. coli
tgcctgtcgtggtagttgatgcact

SEQ ID NO: 219592 - DNA, 25 bp, E. coli
tcgctggccgggtagcacgctgcct

SEQ ID NO: 219593 - DNA, 25 bp, E. coli
tgcctgtcgtggaagttgatgcact

SEQ ID NO: 219594 - DNA, 25 bp, E. coli
tcgctggccgggaagcacgctgcct

SEQ ID NO: 219595 - DNA, 25 bp, E. coli
tcttccattgaatcgagcttaggct

SEQ ID NO: 219596 - DNA, 25 bp, E. coli
tcttccattgaaacgagcttaggct

SEQ ID NO: 219597 - DNA, 25 bp, E. coli
gaatcgagcttaggcttaacgcaac

SEQ ID NO: 219598 - DNA, 25 bp, E. coli
gaatcgagcttacgcttaacgcaac

SEQ ID NO: 219599 - DNA, 25 bp, E. coli
cgcgagcaggtagaggcggcgcacg

SEQ ID NO: 219600 - DNA, 25 bp, E. coli
cgctgcctgtcgaggaagttgatgc

SEQ ID NO: 219601 - DNA, 25 bp, E. coli
cgccggacaccattccagggctgga

SEQ ID NO: 219602 - DNA, 25 bp, E. coli
cgcgagcaggtacaggcggcgcacg

SEQ ID NO: 219603 - DNA, 25 bp, E. coli
cgctgcctgtcgtggaagttgatgc

SEQ ID NO: 219604 - DNA, 25 bp, E. coli
cgccggacaccaatccagggctgga

SEQ ID NO: 219605 - DNA, 25 bp, E. coli
cattgaatcgagcttaggcttaacg

SEQ ID NO: 219606 - DNA, 25 bp, E. coli
cattgaatcgaggttaggcttaacg

SEQ ID NO: 219607 - DNA, 25 bp, E. coli
ctgtcgtggaagttgatgcactgga

SEQ ID NO: 219608 - DNA, 25 bp, E. coli
ctgtcgtggaagatgatgcactgga

SEQ ID NO: 219609 - DNA, 25 bp, E. coli
caaatctctgttgctcgtgaagtca

SEQ ID NO: 219610 - DNA, 25 bp, E. coli
caaatctctgttcctcgtgaagtca

SEQ ID NO: 219611 - DNA, 25 bp, E. coli
caggctgccgttcaatatgcgaaac

SEQ ID NO: 219612 - DNA, 25 bp, E. coli
caggctgccgttgaatatgcgaaac

SEQ ID NO: 219613 - DNA, 25 bp, E. coli
catattacgtggtggtagagagccg

SEQ ID NO: 219614 - DNA, 25 bp, E. coli
catattacgtggaggtagagagccg

SEQ ID NO: 219615 - DNA, 25 bp, E. coli
taaagtggctgaacggcaaatctct

SEQ ID NO: 219616 - DNA, 25 bp, E. coli
taaagtggctgatcggcaaatctct

SEQ ID NO: 219617 - DNA, 25 bp, E. coli
tattttgctgggaaaagatcctcgc

SEQ ID NO: 219618 - DNA, 25 bp, E. coli
tattttgctgggtaaagatcctcgc

SEQ ID NO: 219619 - DNA, 25 bp, E. coli
tgcgtgtcgcaagcgctacagaatt

SEQ ID NO: 219620 - DNA, 25 bp, E. coli
tgcgtgtcgcaaccgctacagaatt

SEQ ID NO: 219621 - DNA, 25 bp, E. coli
cctgctgtgggcgagattcataaag

SEQ ID NO: 219622 - DNA, 25 bp, E. coli
cctgctgtgggccagattcataaag

SEQ ID NO: 219623 - DNA, 25 bp, E. coli
gaaacctcgaactcgtaaaggctgg

SEQ ID NO: 219624 - DNA, 25 bp, E. coli
gaaacctcgaacacgtaaaggctgg

SEQ ID NO: 219625 - DNA, 25 bp, E. coli
gaaagggatacgttatgctcgccag

SEQ ID NO: 219626 - DNA, 25 bp, E. coli
gaaagggatacgatatgctcgccag

SEQ ID NO: 219627 - DNA, 25 bp, E. coli
gaaaccgtaacatggatctctctgc

SEQ ID NO: 219628 - DNA, 25 bp, E. coli
gaaaccgtaacaaggatctctctgc

SEQ ID NO: 219629 - DNA, 25 bp, E. coli
gatgctattcttccagcccgtgaac

SEQ ID NO: 219630 - DNA, 25 bp, E. coli
gatgctattcttgcagcccgtgaac

SEQ ID NO: 219631 - DNA, 25 bp, E. coli
aatacccgtccggacttattgccag

SEQ ID NO: 219632 - DNA, 25 bp, E. coli
aatacccgtccgcacttattgccag

SEQ ID NO: 219633 - DNA, 25 bp, E. coli
aacggattcattatgctgtgtgtca

SEQ ID NO: 219634 - DNA, 25 bp, E. coli
caaaccaacgttaatagccatccta

SEQ ID NO: 219635 - DNA, 25 bp, E. coli
caaaccaacgtttatagccatccta

SEQ ID NO: 219636 - DNA, 25 bp, E. coli
tacatatcgttacacgctgaaacca

SEQ ID NO: 219637 - DNA, 25 bp, E. coli
tacatatcgttagacgctgaaacca

SEQ ID NO: 219638 - DNA, 25 bp, E. coli
tagtaaaatagttaacccgatcaag

SEQ ID NO: 219639 - DNA, 25 bp, E. coli
tagtaaaatagtaaacccgatcaag

SEQ ID NO: 219640 - DNA, 25 bp, E. coli
aacggattcattttgctgtgtgtca

SEQ ID NO: 219641 - DNA, 25 bp, E. coli
tatagttatttctacggccccgcag

SEQ ID NO: 219642 - DNA, 25 bp, E. coli
tatagttatttcaacggccccgcag

SEQ ID NO: 219643 - DNA, 25 bp, E. coli
tcctaaaatagacgaagcgccagcc

SEQ ID NO: 219644 - DNA, 25 bp, E. coli
tcctaaaatagaggaagcgccagcc

SEQ ID NO: 219645 - DNA, 25 bp, E. coli
gctgaaaccaacgactcacggaagt

SEQ ID NO: 219646 - DNA, 25 bp, E. coli
gcgcgtctagcgacatcaggattat

SEQ ID NO: 219647 - DNA, 25 bp, E. coli
gcgcgtctagcgtcatcaggattat

SEQ ID NO: 219648 - DNA, 25 bp, E. coli
gctgaaaccaaccactcacggaagt

SEQ ID NO: 219649 - DNA, 25 bp, E. coli
gaagtctgccattcccagggatata

SEQ ID NO: 219650 - DNA, 25 bp, E. coli
gaagtctgccatacccagggatata

SEQ ID NO: 219651 - DNA, 25 bp, E. coli
gacttattgccacctcaaaccaacg

SEQ ID NO: 219652 - DNA, 25 bp, E. coli
gacttattgccagctcaaaccaacg

SEQ ID NO: 219653 - DNA, 25 bp, E. coli
atatggtggcagacccgggcgaaac

SEQ ID NO: 219654 - DNA, 25 bp, E. coli
atatggtggcagtcccgggcgaaac

SEQ ID NO: 219655 - DNA, 25 bp, E. coli
ttgcgcgctgacgtaacgcttgagg

SEQ ID NO: 219656 - DNA, 25 bp, E. coli
ttgcgcgctgacctaacgcttgagg

SEQ ID NO: 219657 - DNA, 25 bp, E. coli
gcgactaaattgagattttccttaa

SEQ ID NO: 219658 - DNA, 25 bp, E. coli
gcgactaaattgtgattttccttaa

SEQ ID NO: 219659 - DNA, 25 bp, E. coli
ccgcagcaatattttgtttatcctg

SEQ ID NO: 219660 - DNA, 25 bp, E. coli
ccgcagcaatatattgtttatcctg

SEQ ID NO: 219661 - DNA, 25 bp, E. coli
cgtaacgcttgacgtgctgcataaa

SEQ ID NO: 219662 - DNA, 25 bp, E. coli
cgcagctattaagcgcgctaaggaa

SEQ ID NO: 219663 - DNA, 25 bp, E. coli
cgcagctattaaccgcgctaaggaa

SEQ ID NO: 219664 - DNA, 25 bp, E. coli
cgtaacgcttgaggtgctgcataaa

SEQ ID NO: 219665 - DNA, 25 bp, E. coli
cttgaggtgctggataaagcagcga

SEQ ID NO: 219666 - DNA, 25 bp, E. coli
ctgacgtaacgcatgaggtgctgca

SEQ ID NO: 219667 - DNA, 25 bp, E. coli
cttgaggtgctgcataaagcagcga

SEQ ID NO: 219668 - DNA, 25 bp, E. coli
ctgacgtaacgcttgaggtgctgca

SEQ ID NO: 219669 - DNA, 25 bp, E. coli
ggtagccgcagcaattaagcgcgct

SEQ ID NO: 219670 - DNA, 25 bp, E. coli
ggtagccgcagctattaagcgcgct

SEQ ID NO: 219671 - DNA, 25 bp, E. coli
tcactggcgatatggtggcagaccc

SEQ ID NO: 219672 - DNA, 25 bp, E. coli
taagcgcgctaacgaaaaagaaggg

SEQ ID NO: 219673 - DNA, 25 bp, E. coli
tcactggcgataaggtggcagaccc

SEQ ID NO: 219674 - DNA, 25 bp, E. coli
taagcgcgctaaggaaaaagaaggg

SEQ ID NO: 219675 - DNA, 25 bp, E. coli
cagtagagttgctgaatcgccaggt

SEQ ID NO: 219676 - DNA, 25 bp, E. coli
catgaaatgctgcatggcttccgca

SEQ ID NO: 219677 - DNA, 25 bp, E. coli
catgaaatgctggatggcttccgca

SEQ ID NO: 219678 - DNA, 25 bp, E. coli
cagtagagttgcagaatcgccaggt

SEQ ID NO: 219679 - DNA, 25 bp, E. coli
aaaagttacccgctggacatccaca

SEQ ID NO: 219680 - DNA, 25 bp, E. coli
aaaagttacccggtggacatccaca

SEQ ID NO: 219681 - DNA, 25 bp, E. coli
taccatggcagaacgtgcagtgcag

SEQ ID NO: 219682 - DNA, 25 bp, E. coli
taccatggcagatcgtgcagtgcag

SEQ ID NO: 219683 - DNA, 25 bp, E. coli
ttgattaccaaagaagcgcactgga

SEQ ID NO: 219684 - DNA, 25 bp, E. coli
ttgattaccaaacaagcgcactgga

SEQ ID NO: 219685 - DNA, 25 bp, E. coli
gccgcgtctcgccacctggataaat

SEQ ID NO: 219686 - DNA, 25 bp, E. coli
gccgcgtctcgcgacctggataaat

SEQ ID NO: 219687 - DNA, 25 bp, E. coli
gctaatgacgtaggcaaagcgattg

SEQ ID NO: 219688 - DNA, 25 bp, E. coli
gctaatgacgtacgcaaagcgattg

SEQ ID NO: 219689 - DNA, 25 bp, E. coli
cgaaagatgacgacaccgcagatat

SEQ ID NO: 219690 - DNA, 25 bp, E. coli
cgaaagatgacgtcaccgcagatat

SEQ ID NO: 219691 - DNA, 25 bp, E. coli
gatcgatcatctcgataccatggca

SEQ ID NO: 219692 - DNA, 25 bp, E. coli
gggaccactcaagttatcaacagca

SEQ ID NO: 219693 - DNA, 25 bp, E. coli
gggaccactcaacttatcaacagca

SEQ ID NO: 219694 - DNA, 25 bp, E. coli
tggctgaccgtttcgcaatcgtcgc

SEQ ID NO: 219695 - DNA, 25 bp, E. coli
tggctgaccgttacgcaatcgtcgc

SEQ ID NO: 219696 - DNA, 25 bp, E. coli
gatcgatcatctggataccatggca

SEQ ID NO: 219697 - DNA, 25 bp, E. coli
aattgcgccggaaattcatactggc

SEQ ID NO: 219698 - DNA, 25 bp, E. coli
aattgcgccggatattcatactggc

SEQ ID NO: 219699 - DNA, 25 bp, E. coli
caaacactaccctggtgaaatacgg

SEQ ID NO: 219700 - DNA, 25 bp, E. coli
cacaaaaaattcctgggcgttggct

SEQ ID NO: 219701 - DNA, 25 bp, E. coli
cacaaaaaattcgtgggcgttggct

SEQ ID NO: 219702 - DNA, 25 bp, E. coli
caaacactacccaggtgaaatacgg

SEQ ID NO: 219703 - DNA, 25 bp, E. coli
catactggcgatgatgatgcactga

SEQ ID NO: 219704 - DNA, 25 bp, E. coli
catactggcgatcatgatgcactga

SEQ ID NO: 219705 - DNA, 25 bp, E. coli
tacggaaaactacgatacatcgttc

SEQ ID NO: 219706 - DNA, 25 bp, E. coli
tacggaaaactaggatacatcgttc

SEQ ID NO: 219707 - DNA, 25 bp, E. coli
tgatgcactgaacgagattttaact

SEQ ID NO: 219708 - DNA, 25 bp, E. coli
tgatgcactgaaggagattttaact

SEQ ID NO: 219709 - DNA, 25 bp, E. coli
gctcgacgagtgcaaaccaaaacgg

SEQ ID NO: 219710 - DNA, 25 bp, E. coli
gctcgacgagtggaaaccaaaacgg

SEQ ID NO: 219711 - DNA, 25 bp, E. coli
gcagtatttgttcggcctggtgaaa

SEQ ID NO: 219712 - DNA, 25 bp, E. coli
gcagtatttgttgggcctggtgaaa

SEQ ID NO: 219713 - DNA, 25 bp, E. coli
gaacagtacctgttaacgctcgacg

SEQ ID NO: 219714 - DNA, 25 bp, E. coli
gaacagtacctgataacgctcgacg

SEQ ID NO: 219715 - DNA, 25 bp, E. coli
gattttaactcatgtcaccgaggcc

SEQ ID NO: 219716 - DNA, 25 bp, E. coli
gattttaactcaagtcaccgaggcc

SEQ ID NO: 219717 - DNA, 25 bp, E. coli
tggctgatagatcgccgagcagtat

SEQ ID NO: 219718 - DNA, 25 bp, E. coli
tggctgatagatggccgagcagtat

SEQ ID NO: 219719 - DNA, 25 bp, E. coli
caaaaacgcatcacaccgctgatgg

SEQ ID NO: 219720 - DNA, 25 bp, E. coli
caaaaacgcatctcaccgctgatgg

SEQ ID NO: 219721 - DNA, 25 bp, E. coli
tatctgccgttctgctaatgcctga

SEQ ID NO: 219722 - DNA, 25 bp, E. coli
tattggcctaactagcatcgccgac

SEQ ID NO: 219723 - DNA, 25 bp, E. coli
tattggcctaacaagcatcgccgac

SEQ ID NO: 219724 - DNA, 25 bp, E. coli
tatctgccgttcagctaatgcctga

SEQ ID NO: 219725 - DNA, 25 bp, E. coli
tgagcgcttacagccgtcaaaaacg

SEQ ID NO: 219726 - DNA, 25 bp, E. coli
tgagcgcttacacccgtcaaaaacg

SEQ ID NO: 219727 - DNA, 25 bp, E. coli
tcaggaatcctcaccttaagctatg

SEQ ID NO: 219728 - DNA, 25 bp, E. coli
tcaggaatcctctccttaagctatg

SEQ ID NO: 219729 - DNA, 25 bp, E. coli
tctaggcttagggtcactcgtgagc

SEQ ID NO: 219730 - DNA, 25 bp, E. coli
tctaggcttaggctcactcgtgagc

SEQ ID NO: 219731 - DNA, 25 bp, E. coli
gcatcgccgactgacaacaaattaa

SEQ ID NO: 219732 - DNA, 25 bp, E. coli
gcatcgccgactcacaacaaattaa

SEQ ID NO: 219733 - DNA, 25 bp, E. coli
cgcaattattgaggacaagctggat

SEQ ID NO: 219734 - DNA, 25 bp, E. coli
cgcaattattgacgacaagctggat

SEQ ID NO: 219735 - DNA, 25 bp, E. coli
gattctaatcctcaagacgcctcgc

SEQ ID NO: 219736 - DNA, 25 bp, E. coli
gattctaatcctgaagacgcctcgc

SEQ ID NO: 219737 - DNA, 25 bp, E. coli
ggcgcaaattcttcaatagctcgta

SEQ ID NO: 219738 - DNA, 25 bp, E. coli
ggcgcaaattctacaatagctcgta

SEQ ID NO: 219739 - DNA, 25 bp, E. coli
taatgcctgagacagacagcctcaa

SEQ ID NO: 219740 - DNA, 25 bp, E. coli
taatgcctgagagagacagcctcaa

SEQ ID NO: 219741 - DNA, 25 bp, E. coli
caatttgccacggtaagtgcccgtt

SEQ ID NO: 219742 - DNA, 25 bp, E. coli
caatttgccacgctaagtgcccgtt

SEQ ID NO: 219743 - DNA, 25 bp, E. coli
tgtgccccggtagcgcaatttgcca

SEQ ID NO: 219744 - DNA, 25 bp, E. coli
tgtgccccggtaccgcaatttgcca

SEQ ID NO: 219745 - DNA, 25 bp, E. coli
tgacaggcacctatttcagacccgt

SEQ ID NO: 219746 - DNA, 25 bp, E. coli
tgacaggcacctttttcagacccgt

SEQ ID NO: 219747 - DNA, 25 bp, E. coli
tgccacgctaagtgcccgttttgac

SEQ ID NO: 219748 - DNA, 25 bp, E. coli
tgccacgctaagagcccgttttgac

SEQ ID NO: 219749 - DNA, 25 bp, E. coli
ccggtagcgcaaattgccacgctaa

SEQ ID NO: 219750 - DNA, 25 bp, E. coli
gcgcaatttgcctcgctaagtgccc

SEQ ID NO: 219751 - DNA, 25 bp, E. coli
gcgcaatttgccacgctaagtgccc

SEQ ID NO: 219752 - DNA, 25 bp, E. coli
ccggtagcgcaatttgccacgctaa

SEQ ID NO: 219753 - DNA, 25 bp, E. coli
gctaagtgcccgatttgacaggcac

SEQ ID NO: 219754 - DNA, 25 bp, E. coli
gctaagtgcccgttttgacaggcac

SEQ ID NO: 219755 - DNA, 25 bp, E. coli
cgaccgctctcgaggaacagcagac

SEQ ID NO: 219756 - DNA, 25 bp, E. coli
cgttgtgccccgctagcgcaatttg

SEQ ID NO: 219757 - DNA, 25 bp, E. coli
cgcgagcgaccgctctcgtggaaca

SEQ ID NO: 219758 - DNA, 25 bp, E. coli
cgttgtgccccggtagcgcaatttg

SEQ ID NO: 219759 - DNA, 25 bp, E. coli
cgcgagcgaccggtctcgtggaaca

SEQ ID NO: 219760 - DNA, 25 bp, E. coli
cgaccgctctcgtggaacagcagac

SEQ ID NO: 219761 - DNA, 25 bp, E. coli
taagtgcccgttttgacaggcacct

SEQ ID NO: 219762 - DNA, 25 bp, E. coli
taagtgcccgttatgacaggcacct

SEQ ID NO: 219763 - DNA, 25 bp, E. coli
caaaagaaaactagccagaccgatt

SEQ ID NO: 219764 - DNA, 25 bp, E. coli
caaaagaaaacttgccagaccgatt

SEQ ID NO: 219765 - DNA, 25 bp, E. coli
tataccttaaagcatatgccgaagg

SEQ ID NO: 219766 - DNA, 25 bp, E. coli
tataccttaaaggatatgccgaagg

SEQ ID NO: 219767 - DNA, 25 bp, E. coli
ccttgaccagcagcgactggtatga

SEQ ID NO: 219768 - DNA, 25 bp, E. coli
gccagaccgattttacttatgcccg

SEQ ID NO: 219769 - DNA, 25 bp, E. coli
gccagaccgattatacttatgcccg

SEQ ID NO: 219770 - DNA, 25 bp, E. coli
ccttgaccagcaccgactggtatga

SEQ ID NO: 219771 - DNA, 25 bp, E. coli
gaagatgcgatatcgggcagcgcca

SEQ ID NO: 219772 - DNA, 25 bp, E. coli
gaagatgcgataacgggcagcgcca

SEQ ID NO: 219773 - DNA, 25 bp, E. coli
gacgatgcatttagcgattcacagg

SEQ ID NO: 219774 - DNA, 25 bp, E. coli
cccttgttggctatactggttagcg

SEQ ID NO: 219775 - DNA, 25 bp, E. coli
cccttgttggctttactggttagcg

SEQ ID NO: 219776 - DNA, 25 bp, E. coli
gattcacaggcggatcgcggtctat

SEQ ID NO: 219777 - DNA, 25 bp, E. coli
gattgatccttaaactcacgcgcca

SEQ ID NO: 219778 - DNA, 25 bp, E. coli
gattgatccttatactcacgcgcca

SEQ ID NO: 219779 - DNA, 25 bp, E. coli
gattcacaggcgcatcgcggtctat

SEQ ID NO: 219780 - DNA, 25 bp, E. coli
ggtaaaagctttcctgccagctgca

SEQ ID NO: 219781 - DNA, 25 bp, E. coli
ggtaaaagctttgctgccagctgca

SEQ ID NO: 219782 - DNA, 25 bp, E. coli
ggcggatcgcggtctataccttaaa

SEQ ID NO: 219783 - DNA, 25 bp, E. coli
ggcggatcgcggactataccttaaa

SEQ ID NO: 219784 - DNA, 25 bp, E. coli
gacgatgcattttgcgattcacagg

SEQ ID NO: 219785 - DNA, 25 bp, E. coli
aatctcgatccagctgatgttctgc

SEQ ID NO: 219786 - DNA, 25 bp, E. coli
aatctcgatccacctgatgttctgc

SEQ ID NO: 219787 - DNA, 25 bp, E. coli
tatgccgcgaaatagatcacaaact

SEQ ID NO: 219788 - DNA, 25 bp, E. coli
tatgccgcgaaaaagatcacaaact

SEQ ID NO: 219789 - DNA, 25 bp, E. coli
tcgcctgactgatgatgaaacgctt

SEQ ID NO: 219790 - DNA, 25 bp, E. coli
tcgcctgactgaagatgaaacgctt

SEQ ID NO: 219791 - DNA, 25 bp, E. coli
tcttcagtttgatgagcgcggcggc

SEQ ID NO: 219792 - DNA, 25 bp, E. coli
tcttcagtttgaagagcgcggcggc

SEQ ID NO: 219793 - DNA, 25 bp, E. coli
gaactggctgccgacaatctcgatc

SEQ ID NO: 219794 - DNA, 25 bp, E. coli
gaactggctgcccacaatctcgatc

SEQ ID NO: 219795 - DNA, 25 bp, E. coli
gactggcaggaagatgttgatttcg

SEQ ID NO: 219796 - DNA, 25 bp, E. coli
gactggcaggaacatgttgatttcg

SEQ ID NO: 219797 - DNA, 25 bp, E. coli
cggacagtgaagatggtgaaatcaa

SEQ ID NO: 219798 - DNA, 25 bp, E. coli
ctttgccatatcttctggcgggaat

SEQ ID NO: 219799 - DNA, 25 bp, E. coli
ctttgccatatcatctggcgggaat

SEQ ID NO: 219800 - DNA, 25 bp, E. coli
cggacagtgaagttggtgaaatcaa

SEQ ID NO: 219801 - DNA, 25 bp, E. coli
gatatggatctaaacaatcgcctga

SEQ ID NO: 219802 - DNA, 25 bp, E. coli
gatatttttctccaactggctgccg

SEQ ID NO: 219803 - DNA, 25 bp, E. coli
gatatggatctatacaatcgcctga

SEQ ID NO: 219804 - DNA, 25 bp, E. coli
gatatttttctcgaactggctgccg

SEQ ID NO: 219805 - DNA, 25 bp, E. coli
ggagttattcgatccggcggaagac

SEQ ID NO: 219806 - DNA, 25 bp, E. coli
ggagttattcgaaccggcggaagac

SEQ ID NO: 219807 - DNA, 25 bp, E. coli
caccggattttgaggcggtctaaca

SEQ ID NO: 219808 - DNA, 25 bp, E. coli
caccggattttgtggcggtctaaca

SEQ ID NO: 219809 - DNA, 25 bp, E. coli
cggcagaagtggtgtttttgttaca

SEQ ID NO: 219810 - DNA, 25 bp, E. coli
cggcagaagtggagtttttgttaca

SEQ ID NO: 219811 - DNA, 25 bp, E. coli
tttgttacaagagggccgctttggc

SEQ ID NO: 219812 - DNA, 25 bp, E. coli
tttagcagtttttattggcggtggt

SEQ ID NO: 219813 - DNA, 25 bp, E. coli
ttctggctgttttcggcctcaaccg

SEQ ID NO: 219814 - DNA, 25 bp, E. coli
ttctggctgtttacggcctcaaccg

SEQ ID NO: 219815 - DNA, 25 bp, E. coli
tttgttacaagacggccgctttggc

SEQ ID NO: 219816 - DNA, 25 bp, E. coli
tttagcagttttaattggcggtggt

SEQ ID NO: 219817 - DNA, 25 bp, E. coli
tctcaacattttcggcagaagtggt

SEQ ID NO: 219818 - DNA, 25 bp, E. coli
tctcaacattttgggcagaagtggt

SEQ ID NO: 219819 - DNA, 25 bp, E. coli
gcgagatggctgataagtatgcgat

SEQ ID NO: 219820 - DNA, 25 bp, E. coli
gcgagatggctgttaagtatgcgat

SEQ ID NO: 219821 - DNA, 25 bp, E. coli
ggttcagcaggaagacgaacattga

SEQ ID NO: 219822 - DNA, 25 bp, E. coli
ggttcagcaggatgacgaacattga

SEQ ID NO: 219823 - DNA, 25 bp, E. coli
tggaaagtattaatcaccaccggat

SEQ ID NO: 219824 - DNA, 25 bp, E. coli
ggcggtctaacatccttctcaacat

SEQ ID NO: 219825 - DNA, 25 bp, E. coli
tggaaagtattattcaccaccggat

SEQ ID NO: 219826 - DNA, 25 bp, E. coli
ggcggtctaacaaccttctcaacat

SEQ ID NO: 219827 - DNA, 25 bp, E. coli
gacgaacattgatccagtgtggaaa

SEQ ID NO: 219828 - DNA, 25 bp, E. coli
gacgaacattgaaccagtgtggaaa

SEQ ID NO: 219829 - DNA, 25 bp, E. coli
cagacgtgctttcattgacggcgga

SEQ ID NO: 219830 - DNA, 25 bp, E. coli
cgaattaagttcagccaggtggatg

SEQ ID NO: 219831 - DNA, 25 bp, E. coli
cgaattaagttctgccaggtggatg

SEQ ID NO: 219832 - DNA, 25 bp, E. coli
cagacgtgctttgattgacggcgga

SEQ ID NO: 219833 - DNA, 25 bp, E. coli
tacccttggtgaagaagagtacggt

SEQ ID NO: 219834 - DNA, 25 bp, E. coli
tacccttggtgatgaagagtacggt

SEQ ID NO: 219835 - DNA, 25 bp, E. coli
tatcaaaggcgtgacgaatctgcgc

SEQ ID NO: 219836 - DNA, 25 bp, E. coli
tatcaaaggcgtcacgaatctgcgc

SEQ ID NO: 219837 - DNA, 25 bp, E. coli
tcctgaatctcggacagcgggtggt

SEQ ID NO: 219838 - DNA, 25 bp, E. coli
tcctgaatctcgcacagcgggtggt

SEQ ID NO: 219839 - DNA, 25 bp, E. coli
tctggtgaacatggaaaaactgctg

SEQ ID NO: 219840 - DNA, 25 bp, E. coli
tctggtgaacatcgaaaaactgctg

SEQ ID NO: 219841 - DNA, 25 bp, E. coli
gaatgtaacaaagctggccagcgag

SEQ ID NO: 219842 - DNA, 25 bp, E. coli
gaatgtaacaaacctggccagcgag

SEQ ID NO: 219843 - DNA, 25 bp, E. coli
gacaacacggtacttatcgtcctga

SEQ ID NO: 219844 - DNA, 25 bp, E. coli
gacaacacggtagttatcgtcctga

SEQ ID NO: 219845 - DNA, 25 bp, E. coli
gaaagtgcaggagatccgtggctac

SEQ ID NO: 219846 - DNA, 25 bp, E. coli
gaaagtgcaggacatccgtggctac

SEQ ID NO: 219847 - DNA, 25 bp, E. coli
cggattgcgaacacgccagcgttta

SEQ ID NO: 219848 - DNA, 25 bp, E. coli
cggattgcgaactcgccagcgttta

SEQ ID NO: 219849 - DNA, 25 bp, E. coli
gatgtggactataacgacaacacgg

SEQ ID NO: 219850 - DNA, 25 bp, E. coli
gatgtggactattacgacaacacgg

SEQ ID NO: 219851 - DNA, 25 bp, E. coli
aagccgcgctggaaacggaaagtga

SEQ ID NO: 219852 - DNA, 25 bp, E. coli
taaatggcgtcgatgataaaactgg

SEQ ID NO: 219853 - DNA, 25 bp, E. coli
taaatggcgtcgttgataaaactgg

SEQ ID NO: 219854 - DNA, 25 bp, E. coli
aagccgcgctggtaacggaaagtga

SEQ ID NO: 219855 - DNA, 25 bp, E. coli
tgctgaccggggtggtcgaacaaaa

SEQ ID NO: 219856 - DNA, 25 bp, E. coli
tgctgaccggggaggtcgaacaaaa

SEQ ID NO: 219857 - DNA, 25 bp, E. coli
tgaagcacaggatatgctgaccggg

SEQ ID NO: 219858 - DNA, 25 bp, E. coli
tgaagcacaggaaatgctgaccggg

SEQ ID NO: 219859 - DNA, 25 bp, E. coli
tgaatcccgggtaaccgaagagcgg

SEQ ID NO: 219860 - DNA, 25 bp, E. coli
tgaatcccgggttaccgaagagcgg

SEQ ID NO: 219861 - DNA, 25 bp, E. coli
gccagtaaaatcagaagcacaggat

SEQ ID NO: 219862 - DNA, 25 bp, E. coli
gccagtaaaatctgaagcacaggat

SEQ ID NO: 219863 - DNA, 25 bp, E. coli
cgaaagccgcgctggtaacggaaag

SEQ ID NO: 219864 - DNA, 25 bp, E. coli
cgctggtaacggaaagtgatggtaa

SEQ ID NO: 219865 - DNA, 25 bp, E. coli
cgctggtaacggtaagtgatggtaa

SEQ ID NO: 219866 - DNA, 25 bp, E. coli
ccgaagagcggccagtaaaatctga

SEQ ID NO: 219867 - DNA, 25 bp, E. coli
cgaaagccgcgcaggtaacggaaag

SEQ ID NO: 219868 - DNA, 25 bp, E. coli
ccgaagagcggcgagtaaaatctga

SEQ ID NO: 219869 - DNA, 25 bp, E. coli
ggaactcaaaataaatggcgtcgtt

SEQ ID NO: 219870 - DNA, 25 bp, E. coli
ggaactcaaaattaatggcgtcgtt

SEQ ID NO: 219871 - DNA, 25 bp, E. coli
gagcggccagtataatctgaagcac

SEQ ID NO: 219872 - DNA, 25 bp, E. coli
gagcggccagtaaaatctgaagcac

SEQ ID NO: 219873 - DNA, 25 bp, E. coli
aaggagcggattaataaagcctttg

SEQ ID NO: 219874 - DNA, 25 bp, E. coli
aaggacataaggagcggattaataa

SEQ ID NO: 219875 - DNA, 25 bp, E. coli
aaggacataaggtgcggattaataa

SEQ ID NO: 219876 - DNA, 25 bp, E. coli
aaggagcggatttataaagcctttg

SEQ ID NO: 219877 - DNA, 25 bp, E. coli
cataaggagcggattaataaagcct

SEQ ID NO: 219878 - DNA, 25 bp, E. coli
cataaggagcggtttaataaagcct

SEQ ID NO: 219879 - DNA, 25 bp, E. coli
aggtgaaattatcacaactgatgcg

SEQ ID NO: 219880 - DNA, 25 bp, E. coli
aggtgaaattatgacaactgatgcg

SEQ ID NO: 219881 - DNA, 25 bp, E. coli
tttgctgtaaaaggacataaggagc

SEQ ID NO: 219882 - DNA, 25 bp, E. coli
tatttgctgtaaaaggacataagga

SEQ ID NO: 219883 - DNA, 25 bp, E. coli
tatttgctgtaataggacataagga

SEQ ID NO: 219884 - DNA, 25 bp, E. coli
tttgctgtaaaacgacataaggagc

SEQ ID NO: 219885 - DNA, 25 bp, E. coli
tgtaaaaggacaaaaggagcggatt

SEQ ID NO: 219886 - DNA, 25 bp, E. coli
tgtaaaaggacataaggagcggatt

SEQ ID NO: 219887 - DNA, 25 bp, E. coli
tgctgtaaaaggtcataaggagcgg

SEQ ID NO: 219888 - DNA, 25 bp, E. coli
tgctgtaaaaggacataaggagcgg

SEQ ID NO: 219889 - DNA, 25 bp, E. coli
ctgtaaaaggacataaggagcggat

SEQ ID NO: 219890 - DNA, 25 bp, E. coli
ctgtaaaaggacttaaggagcggat

SEQ ID NO: 219891 - DNA, 25 bp, E. coli
gttggatattaatggtgaaattatc

SEQ ID NO: 219892 - DNA, 25 bp, E. coli
gttggatattaaaggtgaaattatc

SEQ ID NO: 219893 - DNA, 25 bp, E. coli
taaaaggacataaggagcggattaa

SEQ ID NO: 219894 - DNA, 25 bp, E. coli
taaaaggacatatggagcggattaa

SEQ ID NO: 219895 - DNA, 25 bp, E. coli
aagagtttgatgatccgctgctgcc

SEQ ID NO: 219896 - DNA, 25 bp, E. coli
aagagtttgatgttccgctgctgcc

SEQ ID NO: 219897 - DNA, 25 bp, E. coli
tacgtctgcctggaaactatggtcg

SEQ ID NO: 219898 - DNA, 25 bp, E. coli
tacgtctgcctgcaaactatggtcg

SEQ ID NO: 219899 - DNA, 25 bp, E. coli
tattgccgactgcatggcgaagcag

SEQ ID NO: 219900 - DNA, 25 bp, E. coli
tattgccgactggatggcgaagcag

SEQ ID NO: 219901 - DNA, 25 bp, E. coli
tgagcgccgggtttcgaatgtctgc

SEQ ID NO: 219902 - DNA, 25 bp, E. coli
tgagcgccgggtatcgaatgtctgc

SEQ ID NO: 219903 - DNA, 25 bp, E. coli
ccacaatggatggaggatgacggta

SEQ ID NO: 219904 - DNA, 25 bp, E. coli
cctggcctgcctagttgaatgataa

SEQ ID NO: 219905 - DNA, 25 bp, E. coli
ccacaatggatgcaggatgacggta

SEQ ID NO: 219906 - DNA, 25 bp, E. coli
cctggcctgccttgttgaatgataa

SEQ ID NO: 219907 - DNA, 25 bp, E. coli
gccgccaacgctcaaccattgttaa

SEQ ID NO: 219908 - DNA, 25 bp, E. coli
gccgccaacgctgaaccattgttaa

SEQ ID NO: 219909 - DNA, 25 bp, E. coli
gataagtggcagtgtaaaacgtcgg

SEQ ID NO: 219910 - DNA, 25 bp, E. coli
gataagtggcagagtaaaacgtcgg

SEQ ID NO: 219911 - DNA, 25 bp, E. coli
ctatggtcgccgatataatgaagcc

SEQ ID NO: 219912 - DNA, 25 bp, E. coli
ctatggtcgccgttataatgaagcc

SEQ ID NO: 219913 - DNA, 25 bp, E. coli
gattctgggtgatagcctgagcgcc

SEQ ID NO: 219914 - DNA, 25 bp, E. coli
gattctgggtgaaagcctgagcgcc

SEQ ID NO: 219915 - DNA, 25 bp, E. coli
gaggtctacctctagccacaatgga

SEQ ID NO: 219916 - DNA, 25 bp, E. coli
gaggtctacctcaagccacaatgga

SEQ ID NO: 219917 - DNA, 25 bp, E. coli
taacaaccatgtggtgccaagtacg

SEQ ID NO: 219918 - DNA, 25 bp, E. coli
tacacagtaaaaatgagcggctgcc

SEQ ID NO: 219919 - DNA, 25 bp, E. coli
taactacgggcagttgcatcgcgac

SEQ ID NO: 219920 - DNA, 25 bp, E. coli
taactacgggcacttgcatcgcgac

SEQ ID NO: 219921 - DNA, 25 bp, E. coli
tacacagtaaaattgagcggctgcc

SEQ ID NO: 219922 - DNA, 25 bp, E. coli
aaagagtttggcctgcccagcacag

SEQ ID NO: 219923 - DNA, 25 bp, E. coli
aaagagtttggcgtgcccagcacag

SEQ ID NO: 219924 - DNA, 25 bp, E. coli
tatgtatgacgaagtaccgccaggc

SEQ ID NO: 219925 - DNA, 25 bp, E. coli
tatgtatgacgatgtaccgccaggc

SEQ ID NO: 219926 - DNA, 25 bp, E. coli
tgaatagccgtaaccacagcggcgg

SEQ ID NO: 219927 - DNA, 25 bp, E. coli
tgaatagccgtatccacagcggcgg

SEQ ID NO: 219928 - DNA, 25 bp, E. coli
tctacaaagaaatgggctgggaccc

SEQ ID NO: 219929 - DNA, 25 bp, E. coli
tctacaaagaaaagggctgggaccc

SEQ ID NO: 219930 - DNA, 25 bp, E. coli
gaatttgttcgatgactacggccta

SEQ ID NO: 219931 - DNA, 25 bp, E. coli
gaatttgttcgaagactacggccta

SEQ ID NO: 219932 - DNA, 25 bp, E. coli
gggctacgcgaataataaactctgg

SEQ ID NO: 219933 - DNA, 25 bp, E. coli
gggctacgcgaaaaataaactctgg

SEQ ID NO: 219934 - DNA, 25 bp, E. coli
tcaccatgccaaagaagcgtcagcg

SEQ ID NO: 219935 - DNA, 25 bp, E. coli
tcaacattgccgatcgtcaggagat

SEQ ID NO: 219936 - DNA, 25 bp, E. coli
tcaacattgccgttcgtcaggagat

SEQ ID NO: 219937 - DNA, 25 bp, E. coli
tcaccatgccaatgaagcgtcagcg

SEQ ID NO: 219938 - DNA, 25 bp, E. coli
taacaaccatgtcgtgccaagtacg

SEQ ID NO: 219939 - DNA, 25 bp, E. coli
atccggcctacacttcgcccgtaag

SEQ ID NO: 219940 - DNA, 25 bp, E. coli
atccggtctacacttcgcccataaa

SEQ ID NO: 219941 - DNA, 25 bp, E. coli
acttcgcccgtaagccgtaggcctg

SEQ ID NO: 219942 - DNA, 25 bp, E. coli
atccggtctacagttcgcccataaa

SEQ ID NO: 219943 - DNA, 25 bp, E. coli
cttcgcccgtaacccgtaggcctga

SEQ ID NO: 219944 - DNA, 25 bp, E. coli
acttcgcccgtatgccgtaggcctg

SEQ ID NO: 219945 - DNA, 25 bp, E. coli
atccggcctacagttcgcccgtaag

SEQ ID NO: 219946 - DNA, 25 bp, E. coli
cttcgcccgtaagccgtaggcctga

SEQ ID NO: 219947 - DNA, 25 bp, E. coli
cgcccgtaagccgtaggcctgataa

SEQ ID NO: 219948 - DNA, 25 bp, E. coli
cgcccgtaagccctaggcctgataa

SEQ ID NO: 219949 - DNA, 25 bp, E. coli
tatccggtctactcttcgcccataa

SEQ ID NO: 219950 - DNA, 25 bp, E. coli
tatccggcctacacttcgcccgtaa

SEQ ID NO: 219951 - DNA, 25 bp, E. coli
tatccggcctactcttcgcccgtaa

SEQ ID NO: 219952 - DNA, 25 bp, E. coli
tatccggtctacacttcgcccataa

SEQ ID NO: 219953 - DNA, 25 bp, E. coli
ttatccggtctacacttcgcccata

SEQ ID NO: 219954 - DNA, 25 bp, E. coli
ttcgcccgtaaggcgtaggcctgat

SEQ ID NO: 219955 - DNA, 25 bp, E. coli
ttcgcccgtaagccgtaggcctgat

SEQ ID NO: 219956 - DNA, 25 bp, E. coli
ttatccggtctagacttcgcccata

SEQ ID NO: 219957 - DNA, 25 bp, E. coli
tccggtctacacttcgcccataaac

SEQ ID NO: 219958 - DNA, 25 bp, E. coli
tccggtctacacatcgcccataaac

SEQ ID NO: 219959 - DNA, 25 bp, E. coli
cggtctacacttcgcccataaaccg

SEQ ID NO: 219960 - DNA, 25 bp, E. coli
cggtctacacttggcccataaaccg

SEQ ID NO: 219961 - DNA, 25 bp, E. coli
aataatagtatgctgatccgctgcc

SEQ ID NO: 219962 - DNA, 25 bp, E. coli
aataatagtatggtgatccgctgcc

SEQ ID NO: 219963 - DNA, 25 bp, E. coli
caaattatggcagaagagttcaccc

SEQ ID NO: 219964 - DNA, 25 bp, E. coli
caaatgccagtgatcagccgttccg

SEQ ID NO: 219965 - DNA, 25 bp, E. coli
caaatgccagtgttcagccgttccg

SEQ ID NO: 219966 - DNA, 25 bp, E. coli
caaattatggcacaagagttcaccc

SEQ ID NO: 219967 - DNA, 25 bp, E. coli
cagccgtgagcctgtcgttacaacg

SEQ ID NO: 219968 - DNA, 25 bp, E. coli
cagccgtgagccagtcgttacaacg

SEQ ID NO: 219969 - DNA, 25 bp, E. coli
tacagatttactgggaatagtcccc

SEQ ID NO: 219970 - DNA, 25 bp, E. coli
tacagatttactcggaatagtcccc

SEQ ID NO: 219971 - DNA, 25 bp, E. coli
tatcctcatgtctgcagagaatgct

SEQ ID NO: 219972 - DNA, 25 bp, E. coli
tatcctcatgtcagcagagaatgct

SEQ ID NO: 219973 - DNA, 25 bp, E. coli
tatatatcacccgatcagccgtgag

SEQ ID NO: 219974 - DNA, 25 bp, E. coli
tatatatcaccccatcagccgtgag

SEQ ID NO: 219975 - DNA, 25 bp, E. coli
ttggttcaccgctaagccgatctgg

SEQ ID NO: 219976 - DNA, 25 bp, E. coli
ttggttcaccgcaaagccgatctgg

SEQ ID NO: 219977 - DNA, 25 bp, E. coli
tgcctacggcaacattcctctgtcg

SEQ ID NO: 219978 - DNA, 25 bp, E. coli
tgcctacggcaagattcctctgtcg

SEQ ID NO: 219979 - DNA, 25 bp, E. coli
cctctgtcgagattgagtgccatga

SEQ ID NO: 219980 - DNA, 25 bp, E. coli
cctctgtcgagaatgagtgccatga

SEQ ID NO: 219981 - DNA, 25 bp, E. coli
taatttgtagtaataggcatccacg

SEQ ID NO: 219982 - DNA, 25 bp, E. coli
taatttgtagtattaggcatccacg

SEQ ID NO: 219983 - DNA, 25 bp, E. coli
caatggctattgttggctcaccgga

SEQ ID NO: 219984 - DNA, 25 bp, E. coli
aacgattgggatagcggcttctgac

SEQ ID NO: 219985 - DNA, 25 bp, E. coli
caatggctattgatggctcaccgga

SEQ ID NO: 219986 - DNA, 25 bp, E. coli
caaatcgctggacattaatacgcgg

SEQ ID NO: 219987 - DNA, 25 bp, E. coli
caaatcgctggagattaatacgcgg

SEQ ID NO: 219988 - DNA, 25 bp, E. coli
catccctgagcgttctgcagaaccg

SEQ ID NO: 219989 - DNA, 25 bp, E. coli
catccctgagcgatctgcagaaccg

SEQ ID NO: 219990 - DNA, 25 bp, E. coli
aacgattgggattgcggcttctgac

SEQ ID NO: 219991 - DNA, 25 bp, E. coli
tatgatcgccatacgaatcgggcca

SEQ ID NO: 219992 - DNA, 25 bp, E. coli
tatgatcgccattcgaatcgggcca

SEQ ID NO: 219993 - DNA, 25 bp, E. coli
taccttatgatcaggttgagcgggc

SEQ ID NO: 219994 - DNA, 25 bp, E. coli
taccttatgatctggttgagcgggc

SEQ ID NO: 219995 - DNA, 25 bp, E. coli
tcccacatcgggtacagcaaatcgc

SEQ ID NO: 219996 - DNA, 25 bp, E. coli
tcccacatcgggaacagcaaatcgc

SEQ ID NO: 219997 - DNA, 25 bp, E. coli
tctgaacgttttcatgcaggcgtcc

SEQ ID NO: 219998 - DNA, 25 bp, E. coli
tctgaacgttttgatgcaggcgtcc

SEQ ID NO: 219999 - DNA, 25 bp, E. coli
gtcgttgcagagcagcgtagcttca

SEQ ID NO: 220000 - DNA, 25 bp, E. coli
gtcgttgcagaggagcgtagcttca

SEQ ID NO: 220001 - DNA, 25 bp, E. coli
taatacgcggtggacgtgaagttcg

SEQ ID NO: 220002 - DNA, 25 bp, E. coli
taatacgcggtgcacgtgaagttcg

SEQ ID NO: 220003 - DNA, 25 bp, E. coli
gagcatggcgcagtcagctttaagc

SEQ ID NO: 220004 - DNA, 25 bp, E. coli
gagcatggcgcactcagctttaagc

SEQ ID NO: 220005 - DNA, 25 bp, E. coli
cacatctggatcttcattacggtga

SEQ ID NO: 220006 - DNA, 25 bp, E. coli
cacatctggatcatcattacggtga

SEQ ID NO: 220007 - DNA, 25 bp, E. coli
tacggtgatcaagggtatgtaaaac

SEQ ID NO: 220008 - DNA, 25 bp, E. coli
tacggtgatcaacggtatgtaaaac

SEQ ID NO: 220009 - DNA, 25 bp, E. coli
agggtatgtaaaacccaccagcctg

SEQ ID NO: 220010 - DNA, 25 bp, E. coli
acccaccagcctgattgacatttaa

SEQ ID NO: 220011 - DNA, 25 bp, E. coli
acccaccagcctcattgacatttaa

SEQ ID NO: 220012 - DNA, 25 bp, E. coli
agggtatgtaaatcccaccagcctg

SEQ ID NO: 220013 - DNA, 25 bp, E. coli
tcatcattacggtgatcaagggtat

SEQ ID NO: 220014 - DNA, 25 bp, E. coli
tcatcattacggagatcaagggtat

SEQ ID NO: 220015 - DNA, 25 bp, E. coli
ccaccattggtgcaaaggcgcacat

SEQ ID NO: 220016 - DNA, 25 bp, E. coli
ccaccattggtggaaaggcgcacat

SEQ ID NO: 220017 - DNA, 25 bp, E. coli
gaaaggcgcacaactggatcatcat

SEQ ID NO: 220018 - DNA, 25 bp, E. coli
gaaaggcgcacatctggatcatcat

SEQ ID NO: 220019 - DNA, 25 bp, E. coli
cattggtggaaaggcgcacatctgg

SEQ ID NO: 220020 - DNA, 25 bp, E. coli
cattggtggaaacgcgcacatctgg

SEQ ID NO: 220021 - DNA, 25 bp, E. coli
ggcggcctgctgtgggcttttccac

SEQ ID NO: 220022 - DNA, 25 bp, E. coli
ggcggcctgctgagggcttttccac

SEQ ID NO: 220023 - DNA, 25 bp, E. coli
tgtgggcttttccaccattggtgga

SEQ ID NO: 220024 - DNA, 25 bp, E. coli
tgtgggcttttcgaccattggtgga

SEQ ID NO: 220025 - DNA, 25 bp, E. coli
tcaagggtatgtaaaacccaccagc

SEQ ID NO: 220026 - DNA, 25 bp, E. coli
tcaagggtatgttaaacccaccagc

SEQ ID NO: 220027 - DNA, 25 bp, E. coli
ttcgtcagtacagcaccgtagtggc

SEQ ID NO: 220028 - DNA, 25 bp, E. coli
ttcgtcagtacaccaccgtagtggc

SEQ ID NO: 220029 - DNA, 25 bp, E. coli
tgggcgaaacagcagagcaacgatc

SEQ ID NO: 220030 - DNA, 25 bp, E. coli
tgggcgaaacaggagagcaacgatc

SEQ ID NO: 220031 - DNA, 25 bp, E. coli
tgagtccgagttcctgtggcagcac

SEQ ID NO: 220032 - DNA, 25 bp, E. coli
tgagtccgagttgctgtggcagcac

SEQ ID NO: 220033 - DNA, 25 bp, E. coli
tccgggccgtatctcaactgaagtt

SEQ ID NO: 220034 - DNA, 25 bp, E. coli
tccgggccgtatgtcaactgaagtt

SEQ ID NO: 220035 - DNA, 25 bp, E. coli
gaagctgtatcaaccgcaggatgcc

SEQ ID NO: 220036 - DNA, 25 bp, E. coli
gaagctgtatcatccgcaggatgcc

SEQ ID NO: 220037 - DNA, 25 bp, E. coli
gaaaccgtggttatgggcgcaagct

SEQ ID NO: 220038 - DNA, 25 bp, E. coli
gaaaccgtggttttgggcgcaagct

SEQ ID NO: 220039 - DNA, 25 bp, E. coli
tggcagcacaaccaggatccaatgg

SEQ ID NO: 220040 - DNA, 25 bp, E. coli
tggcagcacaacgaggatccaatgg

SEQ ID NO: 220041 - DNA, 25 bp, E. coli
taagaaagagtaggctccggcagaa

SEQ ID NO: 220042 - DNA, 25 bp, E. coli
taacgcagcgcagattccggaatac

SEQ ID NO: 220043 - DNA, 25 bp, E. coli
taagttgattgatgatgctgtcgcc

SEQ ID NO: 220044 - DNA, 25 bp, E. coli
tcaaactggcttgtacctggcaggg

SEQ ID NO: 220045 - DNA, 25 bp, E. coli
tcaaactggcttctacctggcaggg

SEQ ID NO: 220046 - DNA, 25 bp, E. coli
taacgcagcgcacattccggaatac

SEQ ID NO: 220047 - DNA, 25 bp, E. coli
taagaaagagtacgctccggcagaa

SEQ ID NO: 220048 - DNA, 25 bp, E. coli
taagttgattgaagatgctgtcgcc

SEQ ID NO: 220049 - DNA, 25 bp, E. coli
aaccatgtccggattctcttcaagt

SEQ ID NO: 220050 - DNA, 25 bp, E. coli
aaccatgtccggtttctcttcaagt

SEQ ID NO: 220051 - DNA, 25 bp, E. coli
cattttgcgggtgctttccggcgat

SEQ ID NO: 220052 - DNA, 25 bp, E. coli
cattttgcgggtcctttccggcgat

SEQ ID NO: 220053 - DNA, 25 bp, E. coli
catgtccggtttctcttcaagttaa

SEQ ID NO: 220054 - DNA, 25 bp, E. coli
catgtccggtttgtcttcaagttaa

SEQ ID NO: 220055 - DNA, 25 bp, E. coli
atcattttgcgggtcctttccggcg

SEQ ID NO: 220056 - DNA, 25 bp, E. coli
accatgtccggtttctcttcaagtt

SEQ ID NO: 220057 - DNA, 25 bp, E. coli
atcattttgcggctcctttccggcg

SEQ ID NO: 220058 - DNA, 25 bp, E. coli
accatgtccggtatctcttcaagtt

SEQ ID NO: 220059 - DNA, 25 bp, E. coli
tattatcattttgcgggtcctttcc

SEQ ID NO: 220060 - DNA, 25 bp, E. coli
tattatcattttccgggtcctttcc

SEQ ID NO: 220061 - DNA, 25 bp, E. coli
tccgggaaccatgtccggtttctct

SEQ ID NO: 220062 - DNA, 25 bp, E. coli
tccgggaaccatctccggtttctct

SEQ ID NO: 220063 - DNA, 25 bp, E. coli
ccatgtccggttactcttcaagtta

SEQ ID NO: 220064 - DNA, 25 bp, E. coli
ccatgtccggtttctcttcaagtta

SEQ ID NO: 220065 - DNA, 25 bp, E. coli
gaaccatgtccgctttctcttcaag

SEQ ID NO: 220066 - DNA, 25 bp, E. coli
gaaccatgtccggtttctcttcaag

SEQ ID NO: 220067 - DNA, 25 bp, E. coli
gataattattatcattttgcgggtc

SEQ ID NO: 220068 - DNA, 25 bp, E. coli
gataattattatgattttgcgggtc

SEQ ID NO: 220069 - DNA, 25 bp, E. coli
taattattatcattttgcgggtcct

SEQ ID NO: 220070 - DNA, 25 bp, E. coli
taattattatcaatttgcgggtcct

SEQ ID NO: 220071 - DNA, 25 bp, E. coli
caaaacaggtttttctcaacgtcgg

SEQ ID NO: 220072 - DNA, 25 bp, E. coli
caaaacaggtttatctcaacgtcgg

SEQ ID NO: 220073 - DNA, 25 bp, E. coli
catcgaaggtttagacgccgccatc

SEQ ID NO: 220074 - DNA, 25 bp, E. coli
catcgaaggttttgacgccgccatc

SEQ ID NO: 220075 - DNA, 25 bp, E. coli
tacgctgccgaaatctcgtctgccg

SEQ ID NO: 220076 - DNA, 25 bp, E. coli
tacgctgccgaattctcgtctgccg

SEQ ID NO: 220077 - DNA, 25 bp, E. coli
ttaaagcgtcataccactaaggcat

SEQ ID NO: 220078 - DNA, 25 bp, E. coli
ttaaagcgtcattccactaaggcat

SEQ ID NO: 220079 - DNA, 25 bp, E. coli
tgttctgtgcaaaaaccgcgatgga

SEQ ID NO: 220080 - DNA, 25 bp, E. coli
tgttctgtgcaataaccgcgatgga

SEQ ID NO: 220081 - DNA, 25 bp, E. coli
tgaagattttaacgctacgctgccg

SEQ ID NO: 220082 - DNA, 25 bp, E. coli
tgaagattttaaggctacgctgccg

SEQ ID NO: 220083 - DNA, 25 bp, E. coli
tgccagcacggatgaaggtaaagcg

SEQ ID NO: 220084 - DNA, 25 bp, E. coli
tgccagcacggaagaaggtaaagcg

SEQ ID NO: 220085 - DNA, 25 bp, E. coli
gcgaaagccgcgaacgataaaggtc

SEQ ID NO: 220086 - DNA, 25 bp, E. coli
gcgaaagccgcgtacgataaaggtc

SEQ ID NO: 220087 - DNA, 25 bp, E. coli
gaaagagaaaggctacaccagtctg

SEQ ID NO: 220088 - DNA, 25 bp, E. coli
gaaagagaaagggtacaccagtctg

SEQ ID NO: 220089 - DNA, 25 bp, E. coli
gtaaagcgcgtgttgccaaatccgc

SEQ ID NO: 220090 - DNA, 25 bp, E. coli
gtaaagcgcgtgatgccaaatccgc

SEQ ID NO: 220091 - DNA, 25 bp, E. coli
gatgccagcaaaaaacttaccccgg

SEQ ID NO: 220092 - DNA, 25 bp, E. coli
gatgccagcaaataacttaccccgg

SEQ ID NO: 220093 - DNA, 25 bp, E. coli
caccgcctgtaaggattgccgtggg

SEQ ID NO: 220094 - DNA, 25 bp, E. coli
caccgcctgtaacgattgccgtggg

SEQ ID NO: 220095 - DNA, 25 bp, E. coli
cagggcgcgggctacagaattactg

SEQ ID NO: 220096 - DNA, 25 bp, E. coli
cagggcgcgggcaacagaattactg

SEQ ID NO: 220097 - DNA, 25 bp, E. coli
catcagtatgaatgacagggcgcgg

SEQ ID NO: 220098 - DNA, 25 bp, E. coli
catcagtatgaaagacagggcgcgg

SEQ ID NO: 220099 - DNA, 25 bp, E. coli
tacgaaaggtgtgtatccgtcttac

SEQ ID NO: 220100 - DNA, 25 bp, E. coli
tacgaaaggtgtctatccgtcttac

SEQ ID NO: 220101 - DNA, 25 bp, E. coli
aaattctatgatccgctggtgaccc

SEQ ID NO: 220102 - DNA, 25 bp, E. coli
aaattctatgatgcgctggtgaccc

SEQ ID NO: 220103 - DNA, 25 bp, E. coli
ttttgaggattatgcccgcagcgca

SEQ ID NO: 220104 - DNA, 25 bp, E. coli
ttttgaggattaagcccgcagcgca

SEQ ID NO: 220105 - DNA, 25 bp, E. coli
cgcagcgagtaataagcagtgccct

SEQ ID NO: 220106 - DNA, 25 bp, E. coli
cgcagcgagtaaaaagcagtgccct

SEQ ID NO: 220107 - DNA, 25 bp, E. coli
cgtgtggcggcgttgagaaaacttc

SEQ ID NO: 220108 - DNA, 25 bp, E. coli
cgtgtggcggcgatgagaaaacttc

SEQ ID NO: 220109 - DNA, 25 bp, E. coli
ggtgacaaaccacataacacgcgcg

SEQ ID NO: 220110 - DNA, 25 bp, E. coli
ggtgacaaaccagataacacgcgcg

SEQ ID NO: 220111 - DNA, 25 bp, E. coli
taagccgccggtatgggcaaagtgt

SEQ ID NO: 220112 - DNA, 25 bp, E. coli
taacacgcgcgtgatgggaaaaaac

SEQ ID NO: 220113 - DNA, 25 bp, E. coli
taagccgccggtttgggcaaagtgt

SEQ ID NO: 220114 - DNA, 25 bp, E. coli
taacacgcgcgtcatgggaaaaaac

SEQ ID NO: 220115 - DNA, 25 bp, E. coli
caaatcgctgtacgaagcggcagag

SEQ ID NO: 220116 - DNA, 25 bp, E. coli
caaatcgctgtaggaagcggcagag

SEQ ID NO: 220117 - DNA, 25 bp, E. coli
caggcaccgctgtggttcgataatc

SEQ ID NO: 220118 - DNA, 25 bp, E. coli
caggcaccgctgaggttcgataatc

SEQ ID NO: 220119 - DNA, 25 bp, E. coli
caggcttttttctggtcgttccgat

SEQ ID NO: 220120 - DNA, 25 bp, E. coli
caggcttttttcaggtcgttccgat

SEQ ID NO: 220121 - DNA, 25 bp, E. coli
actacctcggcgtcgatcttctgca

SEQ ID NO: 220122 - DNA, 25 bp, E. coli
actacctcggcgacgatcttctgca

SEQ ID NO: 220123 - DNA, 25 bp, E. coli
tttgcagaccatggacaaatcgctg

SEQ ID NO: 220124 - DNA, 25 bp, E. coli
ttcgctggtgttcgcctggaaatac

SEQ ID NO: 220125 - DNA, 25 bp, E. coli
ttcgctggtgttggcctggaaatac

SEQ ID NO: 220126 - DNA, 25 bp, E. coli
tttgcagaccatcgacaaatcgctg

SEQ ID NO: 220127 - DNA, 25 bp, E. coli
tctggatgttcttcatgttcgcgga

SEQ ID NO: 220128 - DNA, 25 bp, E. coli
tcattctgctgaccaggaaacgggt

SEQ ID NO: 220129 - DNA, 25 bp, E. coli
tcattctgctgagcaggaaacgggt

SEQ ID NO: 220130 - DNA, 25 bp, E. coli
tctggatgttctacatgttcgcgga

SEQ ID NO: 220131 - DNA, 25 bp, E. coli
gcttattactgctgggcggtctggt

SEQ ID NO: 220132 - DNA, 25 bp, E. coli
gcttattactgcagggcggtctggt

SEQ ID NO: 220133 - DNA, 25 bp, E. coli
gaaacgggtgaacctcaatggcaac

SEQ ID NO: 220134 - DNA, 25 bp, E. coli
gaaacgggtgaagctcaatggcaac

SEQ ID NO: 220135 - DNA, 25 bp, E. coli
gatgtttttcaaccgcgagttccgc

SEQ ID NO: 220136 - DNA, 25 bp, E. coli
gatgtttttcaagcgcgagttccgc

SEQ ID NO: 220137 - DNA, 25 bp, E. coli
caatgttaatgtgggtgataccggc

SEQ ID NO: 220138 - DNA, 25 bp, E. coli
caatgttaatgtcggtgataccggc

SEQ ID NO: 220139 - DNA, 25 bp, E. coli
caaaagcggaagatggagtgccaga

SEQ ID NO: 220140 - DNA, 25 bp, E. coli
caaaagcggaagttggagtgccaga

SEQ ID NO: 220141 - DNA, 25 bp, E. coli
ttcagtacgaaagccggttacggca

SEQ ID NO: 220142 - DNA, 25 bp, E. coli
ttcagtacgaaacccggttacggca

SEQ ID NO: 220143 - DNA, 25 bp, E. coli
tgataccggcagttaccagtggccc

SEQ ID NO: 220144 - DNA, 25 bp, E. coli
tgataccggcagataccagtggccc

SEQ ID NO: 220145 - DNA, 25 bp, E. coli
tgcggcagaccagaaagcgtttgct

SEQ ID NO: 220146 - DNA, 25 bp, E. coli
tgcggcagaccacaaagcgtttgct

SEQ ID NO: 220147 - DNA, 25 bp, E. coli
tctccgtgaatataaaacgccagcg

SEQ ID NO: 220148 - DNA, 25 bp, E. coli
tctccgtgaataaaaaacgccagcg

SEQ ID NO: 220149 - DNA, 25 bp, E. coli
ctttaaagcaggtatgagtgtccgc

SEQ ID NO: 220150 - DNA, 25 bp, E. coli
ctttaaagcaggaatgagtgtccgc

SEQ ID NO: 220151 - DNA, 25 bp, E. coli
gataggccgttcagtgccaaaagcg

SEQ ID NO: 220152 - DNA, 25 bp, E. coli
gataggccgttctgtgccaaaagcg

SEQ ID NO: 220153 - DNA, 25 bp, E. coli
gggatgggatagacagaacctttca

SEQ ID NO: 220154 - DNA, 25 bp, E. coli
gggatgggatagtcagaacctttca

SEQ ID NO: 220155 - DNA, 25 bp, E. coli
ggcatcacgaactatcaggcggacg

SEQ ID NO: 220156 - DNA, 25 bp, E. coli
ggcatcacgaacaatcaggcggacg

SEQ ID NO: 220157 - DNA, 25 bp, E. coli
gatgcctgacctgtggatatagcgg

SEQ ID NO: 220158 - DNA, 25 bp, E. coli
gatgcctgacctctggatatagcgg

SEQ ID NO: 220159 - DNA, 25 bp, E. coli
caaagtttacgaggcgattgccgcg

SEQ ID NO: 220160 - DNA, 25 bp, E. coli
caaagtttacgacgcgattgccgcg

SEQ ID NO: 220161 - DNA, 25 bp, E. coli
aacaatatgtctgcagaactggccg

SEQ ID NO: 220162 - DNA, 25 bp, E. coli
aacaatatgtctccagaactggccg

SEQ ID NO: 220163 - DNA, 25 bp, E. coli
tatggcaggctatccgccgtttgca

SEQ ID NO: 220164 - DNA, 25 bp, E. coli
tatggcaggctaaccgccgtttgca

SEQ ID NO: 220165 - DNA, 25 bp, E. coli
ttgtgatgataatggctgccagctc

SEQ ID NO: 220166 - DNA, 25 bp, E. coli
ttgtgatgataaaggctgccagctc

SEQ ID NO: 220167 - DNA, 25 bp, E. coli
tgcggcgtgcctcaaaatgccatcc

SEQ ID NO: 220168 - DNA, 25 bp, E. coli
tgcggcgtgcctgaaaatgccatcc

SEQ ID NO: 220169 - DNA, 25 bp, E. coli
tcagcgggcgcaacgaaatggcgat

SEQ ID NO: 220170 - DNA, 25 bp, E. coli
tcagcgggcgcatcgaaatggcgat

SEQ ID NO: 220171 - DNA, 25 bp, E. coli
ccattaagcgagaaagacaagccct

SEQ ID NO: 220172 - DNA, 25 bp, E. coli
ccattaagcgagtaagacaagccct

SEQ ID NO: 220173 - DNA, 25 bp, E. coli
gctgcgcatgcatagttaccgtctg

SEQ ID NO: 220174 - DNA, 25 bp, E. coli
gctgcgcatgcaaagttaccgtctg

SEQ ID NO: 220175 - DNA, 25 bp, E. coli
gaaacggtgtcagcggatgtcagcc

SEQ ID NO: 220176 - DNA, 25 bp, E. coli
gaaacggtgtcaccggatgtcagcc

SEQ ID NO: 220177 - DNA, 25 bp, E. coli
cgtaacgaactgaatgcatcctggg

SEQ ID NO: 220178 - DNA, 25 bp, E. coli
cgtaacgaactgtatgcatcctggg

SEQ ID NO: 220179 - DNA, 25 bp, E. coli
gatcgtgatggaagagcgtgccacc

SEQ ID NO: 220180 - DNA, 25 bp, E. coli
gatcgtgatggatgagcgtgccacc

SEQ ID NO: 220181 - DNA, 25 bp, E. coli
caaattgccggataaagtgatggac

SEQ ID NO: 220182 - DNA, 25 bp, E. coli
caaattgccggaaaaagtgatggac

SEQ ID NO: 220183 - DNA, 25 bp, E. coli
catgccatctcgatggtgtaactga

SEQ ID NO: 220184 - DNA, 25 bp, E. coli
catgccatctcgttggtgtaactga

SEQ ID NO: 220185 - DNA, 25 bp, E. coli
taaagtgatggagtacctggagcga

SEQ ID NO: 220186 - DNA, 25 bp, E. coli
taaagtgatggactacctggagcga

SEQ ID NO: 220187 - DNA, 25 bp, E. coli
tatgctgagggatggaacgcttgcc

SEQ ID NO: 220188 - DNA, 25 bp, E. coli
tacctggagcgaagcggacttataa

SEQ ID NO: 220189 - DNA, 25 bp, E. coli
tacctggagcgatgcggacttataa

SEQ ID NO: 220190 - DNA, 25 bp, E. coli
tatgctgagggaaggaacgcttgcc

SEQ ID NO: 220191 - DNA, 25 bp, E. coli
tgtaactgaaacttatgctgaggga

SEQ ID NO: 220192 - DNA, 25 bp, E. coli
tgtaactgaaacatatgctgaggga

SEQ ID NO: 220193 - DNA, 25 bp, E. coli
gcgaattgacaatgctggttaaaca

SEQ ID NO: 220194 - DNA, 25 bp, E. coli
gcgaattgacaaagctggttaaaca

SEQ ID NO: 220195 - DNA, 25 bp, E. coli
gacttataagcgaggaggatgtttc

SEQ ID NO: 220196 - DNA, 25 bp, E. coli
gagcccgggaaacaagttcgcgaat

SEQ ID NO: 220197 - DNA, 25 bp, E. coli
gacttataagcgtggaggatgtttc

SEQ ID NO: 220198 - DNA, 25 bp, E. coli
gagcccgggaaagaagttcgcgaat

SEQ ID NO: 220199 - DNA, 25 bp, E. coli
cgaaaccgggctccaaattgccgga

SEQ ID NO: 220200 - DNA, 25 bp, E. coli
cgaaaccgggctgcaaattgccgga

SEQ ID NO: 220201 - DNA, 25 bp, E. coli
tcaactgaagaatgcgaaaccgggc

SEQ ID NO: 220202 - DNA, 25 bp, E. coli
tcaactgaagaaagcgaaaccgggc

SEQ ID NO: 220203 - DNA, 25 bp, E. coli
aagtaagccgccctttcaggtggat

SEQ ID NO: 220204 - DNA, 25 bp, E. coli
aagtaagccgccgtttcaggtggat

SEQ ID NO: 220205 - DNA, 25 bp, E. coli
cagaggtgttgtctgagagtaatca

SEQ ID NO: 220206 - DNA, 25 bp, E. coli
cagaggtgttgtgtgagagtaatca

SEQ ID NO: 220207 - DNA, 25 bp, E. coli
taaaaattatctgcagttaccagag

SEQ ID NO: 220208 - DNA, 25 bp, E. coli
tacgatcacattagcagttatgccc

SEQ ID NO: 220209 - DNA, 25 bp, E. coli
taaaaattatctccagttaccagag

SEQ ID NO: 220210 - DNA, 25 bp, E. coli
tacgatcacatttgcagttatgccc

SEQ ID NO: 220211 - DNA, 25 bp, E. coli
ttgacaatacgaatatcacactgtg

SEQ ID NO: 220212 - DNA, 25 bp, E. coli
ttgacaatacgattatcacactgtg

SEQ ID NO: 220213 - DNA, 25 bp, E. coli
tcaggtggattacttttctcaggtc

SEQ ID NO: 220214 - DNA, 25 bp, E. coli
tctcaggtctctagtaattgaaata

SEQ ID NO: 220215 - DNA, 25 bp, E. coli
tcaggtggattagttttctcaggtc

SEQ ID NO: 220216 - DNA, 25 bp, E. coli
tctcaggtctcttgtaattgaaata

SEQ ID NO: 220217 - DNA, 25 bp, E. coli
gcagttatgcccatatgctaaaaat

SEQ ID NO: 220218 - DNA, 25 bp, E. coli
gcagttatgcccttatgctaaaaat

SEQ ID NO: 220219 - DNA, 25 bp, E. coli
taataaataacatggaaagcagagg

SEQ ID NO: 220220 - DNA, 25 bp, E. coli
taataaataacaaggaaagcagagg

SEQ ID NO: 220221 - DNA, 25 bp, E. coli
tcgtattcccatatgtaatagacaa

SEQ ID NO: 220222 - DNA, 25 bp, E. coli
gagtaatcacgcatctgctttttaa

SEQ ID NO: 220223 - DNA, 25 bp, E. coli
gagtaatcacgcttctgctttttaa

SEQ ID NO: 220224 - DNA, 25 bp, E. coli
tcgtattcccatttgtaatagacaa

SEQ ID NO: 220225 - DNA, 25 bp, E. coli
tacccggaacacaaaccctatggtg

SEQ ID NO: 220226 - DNA, 25 bp, E. coli
aactctgtatttcgcctgtaacggg

SEQ ID NO: 220227 - DNA, 25 bp, E. coli
aactctgtatttggcctgtaacggg

SEQ ID NO: 220228 - DNA, 25 bp, E. coli
tacccggaacactaaccctatggtg

SEQ ID NO: 220229 - DNA, 25 bp, E. coli
tgttgttgaagtggacgaactgccg

SEQ ID NO: 220230 - DNA, 25 bp, E. coli
tgttgttgaagtcgacgaactgccg

SEQ ID NO: 220231 - DNA, 25 bp, E. coli
tcagtatttccacagtgaggacgga

SEQ ID NO: 220232 - DNA, 25 bp, E. coli
tcagtatttccagagtgaggacgga

SEQ ID NO: 220233 - DNA, 25 bp, E. coli
gctccaggaagccaacgaaactgtg

SEQ ID NO: 220234 - DNA, 25 bp, E. coli
gctccaggaagcgaacgaaactgtg

SEQ ID NO: 220235 - DNA, 25 bp, E. coli
gaagacggttgcagaaaagcgccgc

SEQ ID NO: 220236 - DNA, 25 bp, E. coli
gaagacggttgctgaaaagcgccgc

SEQ ID NO: 220237 - DNA, 25 bp, E. coli
gaagatgtctctgctttatatccgg

SEQ ID NO: 220238 - DNA, 25 bp, E. coli
gaagatgtctctcctttatatccgg

SEQ ID NO: 220239 - DNA, 25 bp, E. coli
gaaactgtggatcactggaaaacgg

SEQ ID NO: 220240 - DNA, 25 bp, E. coli
gaaaataaattagagctgacgcgct

SEQ ID NO: 220241 - DNA, 25 bp, E. coli
gaaaataaattacagctgacgcgct

SEQ ID NO: 220242 - DNA, 25 bp, E. coli
gaaactgtggatgactggaaaacgg

SEQ ID NO: 220243 - DNA, 25 bp, E. coli
gatggcctgataacaaaggtgccgg

SEQ ID NO: 220244 - DNA, 25 bp, E. coli
gatggcgtatatgcgacagcttaaa

SEQ ID NO: 220245 - DNA, 25 bp, E. coli
gatggcgtatatccgacagcttaaa

SEQ ID NO: 220246 - DNA, 25 bp, E. coli
gatggcctgatatcaaaggtgccgg

SEQ ID NO: 220247 - DNA, 25 bp, E. coli
caaatttttgcataggcggatggtc

SEQ ID NO: 220248 - DNA, 25 bp, E. coli
caaatttttgcaaaggcggatggtc

SEQ ID NO: 220249 - DNA, 25 bp, E. coli
aatggtcccgcgctggtcgttttca

SEQ ID NO: 220250 - DNA, 25 bp, E. coli
aatggtcccgcggtggtcgttttca

SEQ ID NO: 220251 - DNA, 25 bp, E. coli
actgagagaatatgcataaatcggc

SEQ ID NO: 220252 - DNA, 25 bp, E. coli
actgagagaataagcataaatcggc

SEQ ID NO: 220253 - DNA, 25 bp, E. coli
ttttatgtcgatgggatgagcctga

SEQ ID NO: 220254 - DNA, 25 bp, E. coli
ttttatgtcgatcggatgagcctga

SEQ ID NO: 220255 - DNA, 25 bp, E. coli
tctggtgttgtgaatggtcccgcgc

SEQ ID NO: 220256 - DNA, 25 bp, E. coli
tctggtgttgtgtatggtcccgcgc

SEQ ID NO: 220257 - DNA, 25 bp, E. coli
cctgaaagtgagtccttctggtgtt

SEQ ID NO: 220258 - DNA, 25 bp, E. coli
cctgaaagtgagaccttctggtgtt

SEQ ID NO: 220259 - DNA, 25 bp, E. coli
gaaagtgcttatatatgaccgctca

SEQ ID NO: 220260 - DNA, 25 bp, E. coli
gaaagtgcttatttatgaccgctca

SEQ ID NO: 220261 - DNA, 25 bp, E. coli
cgttttcagcggcaagaaagtgctt

SEQ ID NO: 220262 - DNA, 25 bp, E. coli
cgttttcagcgggaagaaagtgctt

SEQ ID NO: 220263 - DNA, 25 bp, E. coli
ggatgagcctgaatcgtttgtaaaa

SEQ ID NO: 220264 - DNA, 25 bp, E. coli
ggatgagcctgattcgtttgtaaaa

SEQ ID NO: 220265 - DNA, 25 bp, E. coli
taatccaattgttgaactgagagaa

SEQ ID NO: 220266 - DNA, 25 bp, E. coli
taatccaattgtagaactgagagaa

SEQ ID NO: 220267 - DNA, 25 bp, E. coli
gaccgctcactctagacaatattta

SEQ ID NO: 220268 - DNA, 25 bp, E. coli
gaccgctcactcaagacaatattta

SEQ ID NO: 220269 - DNA, 25 bp, E. coli
aatgctgctgcttaaacgtctggac

SEQ ID NO: 220270 - DNA, 25 bp, E. coli
aatgctgctgctaaaacgtctggac

SEQ ID NO: 220271 - DNA, 25 bp, E. coli
catatcttcgggtgggaacaccaac

SEQ ID NO: 220272 - DNA, 25 bp, E. coli
catatcttcgggagggaacaccaac

SEQ ID NO: 220273 - DNA, 25 bp, E. coli
tacaacacattacggtgggcggcga

SEQ ID NO: 220274 - DNA, 25 bp, E. coli
tacaacacattagggtgggcggcga

SEQ ID NO: 220275 - DNA, 25 bp, E. coli
tccttgaaaacgatcccagtccggg

SEQ ID NO: 220276 - DNA, 25 bp, E. coli
tccttgaaaacgttcccagtccggg

SEQ ID NO: 220277 - DNA, 25 bp, E. coli
tatttattaacaggttgccgctgcg

SEQ ID NO: 220278 - DNA, 25 bp, E. coli
tattcggcgcgacaatatcagggcg

SEQ ID NO: 220279 - DNA, 25 bp, E. coli
tattcggcgcgagaatatcagggcg

SEQ ID NO: 220280 - DNA, 25 bp, E. coli
tatttattaacacgttgccgctgcg

SEQ ID NO: 220281 - DNA, 25 bp, E. coli
tttactcttgagcatgcgctgcacg

SEQ ID NO: 220282 - DNA, 25 bp, E. coli
tttactcttgaggatgcgctgcacg

SEQ ID NO: 220283 - DNA, 25 bp, E. coli
tcagtgatgaagagttgcgcgcgca

SEQ ID NO: 220284 - DNA, 25 bp, E. coli
tggcaaactctgcaacacgctgggt

SEQ ID NO: 220285 - DNA, 25 bp, E. coli
tggttatactcccaacgaggcggaa

SEQ ID NO: 220286 - DNA, 25 bp, E. coli
tggttatactccgaacgaggcggaa

SEQ ID NO: 220287 - DNA, 25 bp, E. coli
tggcaaactctggaacacgctgggt

SEQ ID NO: 220288 - DNA, 25 bp, E. coli
tcagtgatgaagtgttgcgcgcgca

SEQ ID NO: 220289 - DNA, 25 bp, E. coli
gacctattcggagttggcagcacaa

SEQ ID NO: 220290 - DNA, 25 bp, E. coli
gacctattcggacttggcagcacaa

SEQ ID NO: 220291 - DNA, 25 bp, E. coli
caagcgacagcaacgcggtcatcga

SEQ ID NO: 220292 - DNA, 25 bp, E. coli
caagcgacagcatcgcggtcatcga

SEQ ID NO: 220293 - DNA, 25 bp, E. coli
caatgtgcccggacgatgaagtatg

SEQ ID NO: 220294 - DNA, 25 bp, E. coli
caatgtgcccggtcgatgaagtatg

SEQ ID NO: 220295 - DNA, 25 bp, E. coli
caggcactggctggaggcgaaagcc

SEQ ID NO: 220296 - DNA, 25 bp, E. coli
caggcactggctcgaggcgaaagcc

SEQ ID NO: 220297 - DNA, 25 bp, E. coli
accggcgttactcattgccgatcgc

SEQ ID NO: 220298 - DNA, 25 bp, E. coli
attctgacccgtcatgccgcaagcg

SEQ ID NO: 220299 - DNA, 25 bp, E. coli
accggcgttactgattgccgatcgc

SEQ ID NO: 220300 - DNA, 25 bp, E. coli
attctgacccgtgatgccgcaagcg

SEQ ID NO: 220301 - DNA, 25 bp, E. coli
tctcgctggcgggactgtcgttctg

SEQ ID NO: 220302 - DNA, 25 bp, E. coli
tctcgctggcggcactgtcgttctg

SEQ ID NO: 220303 - DNA, 25 bp, E. coli
gaaccggcgttactgattgccgatc

SEQ ID NO: 220304 - DNA, 25 bp, E. coli
gaaccggcgttagtgattgccgatc

SEQ ID NO: 220305 - DNA, 25 bp, E. coli
cccggacgatgaagtatgggttgcc

SEQ ID NO: 220306 - DNA, 25 bp, E. coli
cccggacgatgatgtatgggttgcc

SEQ ID NO: 220307 - DNA, 25 bp, E. coli
cgtcatgccgcatgcgacagcatcg

SEQ ID NO: 220308 - DNA, 25 bp, E. coli
cgtcatgccgcaagcgacagcatcg

SEQ ID NO: 220309 - DNA, 25 bp, E. coli
gggttacccaatctgcccggacgat

SEQ ID NO: 220310 - DNA, 25 bp, E. coli
gggttacccaatgtgcccggacgat

SEQ ID NO: 220311 - DNA, 25 bp, E. coli
ggcactgtcgttgtggctgccgacc

SEQ ID NO: 220312 - DNA, 25 bp, E. coli
ggcactgtcgttctggctgccgacc

SEQ ID NO: 220313 - DNA, 25 bp, E. coli
aacctttgatagtgtgtgggatgcg

SEQ ID NO: 220314 - DNA, 25 bp, E. coli
aacctttgatagagtgtgggatgcg

SEQ ID NO: 220315 - DNA, 25 bp, E. coli
acccctgaacaaccggaaaatatgc

SEQ ID NO: 220316 - DNA, 25 bp, E. coli
acccctgaacaagcggaaaatatgc

SEQ ID NO: 220317 - DNA, 25 bp, E. coli
agttcaatatccacatgctgcttag

SEQ ID NO: 220318 - DNA, 25 bp, E. coli
agttcaatatcctcatgctgcttag

SEQ ID NO: 220319 - DNA, 25 bp, E. coli
tagccaggctcaggcagcttctgct

SEQ ID NO: 220320 - DNA, 25 bp, E. coli
tagccaggctcacgcagcttctgct

SEQ ID NO: 220321 - DNA, 25 bp, E. coli
tgaacaacaagggtttagccaggct

SEQ ID NO: 220322 - DNA, 25 bp, E. coli
tgaacaacaaggctttagccaggct

SEQ ID NO: 220323 - DNA, 25 bp, E. coli
ccatgatggctcatgcaggactaca

SEQ ID NO: 220324 - DNA, 25 bp, E. coli
ccatgatggctcttgcaggactaca

SEQ ID NO: 220325 - DNA, 25 bp, E. coli
gaacttgccagacgtaaaatccaga

SEQ ID NO: 220326 - DNA, 25 bp, E. coli
gaacttgccagaggtaaaatccaga

SEQ ID NO: 220327 - DNA, 25 bp, E. coli
gaaaatatgcggatccgtgccgagc

SEQ ID NO: 220328 - DNA, 25 bp, E. coli
gaaaatatgcggttccgtgccgagc

SEQ ID NO: 220329 - DNA, 25 bp, E. coli
cgtgccgagcttctaacgatcatta

SEQ ID NO: 220330 - DNA, 25 bp, E. coli
cgtgccgagcttgtaacgatcatta

SEQ ID NO: 220331 - DNA, 25 bp, E. coli
gggtcactcaacctcgcatctctga

SEQ ID NO: 220332 - DNA, 25 bp, E. coli
gggtcactcaacgtcgcatctctga

SEQ ID NO: 220333 - DNA, 25 bp, E. coli
ggatgcggtgagagacacccctgaa

SEQ ID NO: 220334 - DNA, 25 bp, E. coli
ggatgcggtgagtgacacccctgaa

SEQ ID NO: 220335 - DNA, 25 bp, E. coli
tacaagcattaaccaggatcacagg

SEQ ID NO: 220336 - DNA, 25 bp, E. coli
tacaagcattaagcaggatcacagg

SEQ ID NO: 220337 - DNA, 25 bp, E. coli
taccgcgtcaggtaaaaatgaatgc

SEQ ID NO: 220338 - DNA, 25 bp, E. coli
taccgcgtcaggaaaaaatgaatgc

SEQ ID NO: 220339 - DNA, 25 bp, E. coli
tatagcgatgatccagatgcctttg

SEQ ID NO: 220340 - DNA, 25 bp, E. coli
tatagcgatgatgcagatgcctttg

SEQ ID NO: 220341 - DNA, 25 bp, E. coli
ttctgaagcaatgtcgccatctgga

SEQ ID NO: 220342 - DNA, 25 bp, E. coli
ttctgaagcaatctcgccatctgga

SEQ ID NO: 220343 - DNA, 25 bp, E. coli
tgtttggcttcaccacggcacttcg

SEQ ID NO: 220344 - DNA, 25 bp, E. coli
tgtttggcttcagcacggcacttcg

SEQ ID NO: 220345 - DNA, 25 bp, E. coli
tcgtccaaaggccttagcaaatggt

SEQ ID NO: 220346 - DNA, 25 bp, E. coli
tcgtccaaaggcgttagcaaatggt

SEQ ID NO: 220347 - DNA, 25 bp, E. coli
tcttcgtgtgaaaggagacagcatg

SEQ ID NO: 220348 - DNA, 25 bp, E. coli
tcttcgtgtgaatggagacagcatg

SEQ ID NO: 220349 - DNA, 25 bp, E. coli
ccatcgagatgagcgaagagcgcga

SEQ ID NO: 220350 - DNA, 25 bp, E. coli
ccatcgagatgaccgaagagcgcga

SEQ ID NO: 220351 - DNA, 25 bp, E. coli
gcatgtggcccagaataaaatcagg

SEQ ID NO: 220352 - DNA, 25 bp, E. coli
gcatgtggcccacaataaaatcagg

SEQ ID NO: 220353 - DNA, 25 bp, E. coli
gagcctaacacctaagtattcccgg

SEQ ID NO: 220354 - DNA, 25 bp, E. coli
gagcctaacaccaaagtattcccgg

SEQ ID NO: 220355 - DNA, 25 bp, E. coli
cgcgatgggtgggtcaaaatttata

SEQ ID NO: 220356 - DNA, 25 bp, E. coli
cgcgatgggtggctcaaaatttata

SEQ ID NO: 220357 - DNA, 25 bp, E. coli
cacgaattttgaggtatttagtgca

SEQ ID NO: 220358 - DNA, 25 bp, E. coli
cacgaattttgacgtatttagtgca

SEQ ID NO: 220359 - DNA, 25 bp, E. coli
tactgtactgcacgtaacaaaaaac

SEQ ID NO: 220360 - DNA, 25 bp, E. coli
tactgtactgcaggtaacaaaaaac

SEQ ID NO: 220361 - DNA, 25 bp, E. coli
atttttcagcaacggaaaattgagg

SEQ ID NO: 220362 - DNA, 25 bp, E. coli
agtatacgtgttgcgcgcaaaacgc

SEQ ID NO: 220363 - DNA, 25 bp, E. coli
agtatacgtgttccgcgcaaaacgc

SEQ ID NO: 220364 - DNA, 25 bp, E. coli
atttttcagcaagggaaaattgagg

SEQ ID NO: 220365 - DNA, 25 bp, E. coli
aaagcacactgttttatgtcaacac

SEQ ID NO: 220366 - DNA, 25 bp, E. coli
aaagcacactgtattatgtcaacac

SEQ ID NO: 220367 - DNA, 25 bp, E. coli
tatgtcaacacacaaagtatacgtg

SEQ ID NO: 220368 - DNA, 25 bp, E. coli
tatgtcaacacagaaagtatacgtg

SEQ ID NO: 220369 - DNA, 25 bp, E. coli
tttatacaagcagagctttacaggg

SEQ ID NO: 220370 - DNA, 25 bp, E. coli
tttatacaagcacagctttacaggg

SEQ ID NO: 220371 - DNA, 25 bp, E. coli
ccggagcgaggtatcgtcagccgcc

SEQ ID NO: 220372 - DNA, 25 bp, E. coli
gcaaaacgcgcattttcggcacgaa

SEQ ID NO: 220373 - DNA, 25 bp, E. coli
gcaaaacgcgcaatttcggcacgaa

SEQ ID NO: 220374 - DNA, 25 bp, E. coli
ccggagcgaggtttcgtcagccgcc

SEQ ID NO: 220375 - DNA, 25 bp, E. coli
gggttgatcacgttttgtactgtac

SEQ ID NO: 220376 - DNA, 25 bp, E. coli
gggttgatcacgatttgtactgtac

SEQ ID NO: 220377 - DNA, 25 bp, E. coli
ggctggtaaccggaaagcacactgt

SEQ ID NO: 220378 - DNA, 25 bp, E. coli
ggctggtaaccgcaaagcacactgt

SEQ ID NO: 220379 - DNA, 25 bp, E. coli
tattgacggtctcgagcaactccgg

SEQ ID NO: 220380 - DNA, 25 bp, E. coli
tattgacggtctggagcaactccgg

SEQ ID NO: 220381 - DNA, 25 bp, E. coli
tattaacgtcattgtgggcgtgccg

SEQ ID NO: 220382 - DNA, 25 bp, E. coli
tattaacgtcatagtgggcgtgccg

SEQ ID NO: 220383 - DNA, 25 bp, E. coli
tgaacttattgatggcggcgtactg

SEQ ID NO: 220384 - DNA, 25 bp, E. coli
tgaacttattgaaggcggcgtactg

SEQ ID NO: 220385 - DNA, 25 bp, E. coli
ccaaaaaggcggttgtgctggccat

SEQ ID NO: 220386 - DNA, 25 bp, E. coli
ccaaaaaggcggatgtgctggccat

SEQ ID NO: 220387 - DNA, 25 bp, E. coli
gattgtttaaagctggacgccgcgc

SEQ ID NO: 220388 - DNA, 25 bp, E. coli
gattgtttaaaggtggacgccgcgc

SEQ ID NO: 220389 - DNA, 25 bp, E. coli
ggtgcttattggtaacccgcgcgga

SEQ ID NO: 220390 - DNA, 25 bp, E. coli
ggtgcttattggaaacccgcgcgga

SEQ ID NO: 220391 - DNA, 25 bp, E. coli
gggattgattacacccgcgcgaaca

SEQ ID NO: 220392 - DNA, 25 bp, E. coli
gggattgattactcccgcgcgaaca

SEQ ID NO: 220393 - DNA, 25 bp, E. coli
ggagcgttacgcgttctgacacata

SEQ ID NO: 220394 - DNA, 25 bp, E. coli
tggaaacgcagacagttcaggagct

SEQ ID NO: 220395 - DNA, 25 bp, E. coli
ggaaccgccgcactttgtggaaacg

SEQ ID NO: 220396 - DNA, 25 bp, E. coli
tggaaacgcagagagttcaggagct

SEQ ID NO: 220397 - DNA, 25 bp, E. coli
ggaaccgccgcagtttgtggaaacg

SEQ ID NO: 220398 - DNA, 25 bp, E. coli
ggagcgttacgccttctgacacata

SEQ ID NO: 220399 - DNA, 25 bp, E. coli
gacgccgcgcctatgatgatttatc

SEQ ID NO: 220400 - DNA, 25 bp, E. coli
gacgccgcgcctttgatgatttatc

SEQ ID NO: 220401 - DNA, 25 bp, E. coli
caaggttattatcatggctatacaa

SEQ ID NO: 220402 - DNA, 25 bp, E. coli
caaggttattatgatggctatacaa

SEQ ID NO: 220403 - DNA, 25 bp, E. coli
caccgcaaaaattcagagtattgag

SEQ ID NO: 220404 - DNA, 25 bp, E. coli
caccgcaaaaatacagagtattgag

SEQ ID NO: 220405 - DNA, 25 bp, E. coli
cagagtattgagcaaaagagagaag

SEQ ID NO: 220406 - DNA, 25 bp, E. coli
cagagtattgaggaaaagagagaag

SEQ ID NO: 220407 - DNA, 25 bp, E. coli
tgaaaccaccgctaaaattcagagt

SEQ ID NO: 220408 - DNA, 25 bp, E. coli
tgaaaccaccgcaaaaattcagagt

SEQ ID NO: 220409 - DNA, 25 bp, E. coli
tccttcttgaaaccaccgcaaaaat

SEQ ID NO: 220410 - DNA, 25 bp, E. coli
tccttcttgaaagcaccgcaaaaat

SEQ ID NO: 220411 - DNA, 25 bp, E. coli
tctcttaaagaaaaaatccttcttg

SEQ ID NO: 220412 - DNA, 25 bp, E. coli
tctcttaaagaataaatccttcttg

SEQ ID NO: 220413 - DNA, 25 bp, E. coli
gaaaaatttctgatggattgaaaga

SEQ ID NO: 220414 - DNA, 25 bp, E. coli
gaaaaatttctgttggattgaaaga

SEQ ID NO: 220415 - DNA, 25 bp, E. coli
ggataattttattcccttgataagc

SEQ ID NO: 220416 - DNA, 25 bp, E. coli
ggataattttatacccttgataagc

SEQ ID NO: 220417 - DNA, 25 bp, E. coli
gagagaagaaaaatttattcaaggt

SEQ ID NO: 220418 - DNA, 25 bp, E. coli
gatggattgaaagaaatagtttctc

SEQ ID NO: 220419 - DNA, 25 bp, E. coli
gatggctatacaaaaggcattattg

SEQ ID NO: 220420 - DNA, 25 bp, E. coli
gatggctatacataaggcattattg

SEQ ID NO: 220421 - DNA, 25 bp, E. coli
gatggattgaaacaaatagtttctc

SEQ ID NO: 220422 - DNA, 25 bp, E. coli
gagagaagaaaattttattcaaggt

SEQ ID NO: 220423 - DNA, 25 bp, E. coli
caacaacatgtaatgtagatagcta

SEQ ID NO: 220424 - DNA, 25 bp, E. coli
caacaacatgtattgtagatagcta

SEQ ID NO: 220425 - DNA, 25 bp, E. coli
tatccggtcccataaaagacaagcc

SEQ ID NO: 220426 - DNA, 25 bp, E. coli
tatccggtcccaaaaaagacaagcc

SEQ ID NO: 220427 - DNA, 25 bp, E. coli
aaagcctgtagttttgacatgcgcc

SEQ ID NO: 220428 - DNA, 25 bp, E. coli
aaagcctgtagtattgacatgcgcc

SEQ ID NO: 220429 - DNA, 25 bp, E. coli
tgtagatagctaaacagtgtaccaa

SEQ ID NO: 220430 - DNA, 25 bp, E. coli
tgtagatagctatacagtgtaccaa

SEQ ID NO: 220431 - DNA, 25 bp, E. coli
gaaacagagatagacaacacaaaag

SEQ ID NO: 220432 - DNA, 25 bp, E. coli
gacaagccagcgacaaagaactgca

SEQ ID NO: 220433 - DNA, 25 bp, E. coli
gacatggctatctaaaactatagaa

SEQ ID NO: 220434 - DNA, 25 bp, E. coli
gaactgcatacttacatcaacaaca

SEQ ID NO: 220435 - DNA, 25 bp, E. coli
gaaacagagatacacaacacaaaag

SEQ ID NO: 220436 - DNA, 25 bp, E. coli
gacatggctatcaaaaactatagaa

SEQ ID NO: 220437 - DNA, 25 bp, E. coli
gacaagccagcgtcaaagaactgca

SEQ ID NO: 220438 - DNA, 25 bp, E. coli
gaactgcatactaacatcaacaaca

SEQ ID NO: 220439 - DNA, 25 bp, E. coli
gcgcaggagaaagaaccccaaaact

SEQ ID NO: 220440 - DNA, 25 bp, E. coli
gcgcaggagaaacaaccccaaaact

SEQ ID NO: 220441 - DNA, 25 bp, E. coli
ctcagttactgagatgacatggcta

SEQ ID NO: 220442 - DNA, 25 bp, E. coli
ctcagttactgacatgacatggcta

SEQ ID NO: 220443 - DNA, 25 bp, E. coli
tcaagttcacaactacattacccgg

SEQ ID NO: 220444 - DNA, 25 bp, E. coli
tcaagttcacaagtacattacccgg

SEQ ID NO: 220445 - DNA, 25 bp, E. coli
aagaggctggctcctatgataaggc

SEQ ID NO: 220446 - DNA, 25 bp, E. coli
catcaggatgggaaatagggtaaaa

SEQ ID NO: 220447 - DNA, 25 bp, E. coli
catcaggatgggtaatagggtaaaa

SEQ ID NO: 220448 - DNA, 25 bp, E. coli
taaattgggattattacgcatcagg

SEQ ID NO: 220449 - DNA, 25 bp, E. coli
taaattgggatttttacgcatcagg

SEQ ID NO: 220450 - DNA, 25 bp, E. coli
accacgtttttcgagaagcaagaga

SEQ ID NO: 220451 - DNA, 25 bp, E. coli
accacgtttttccagaagcaagaga

SEQ ID NO: 220452 - DNA, 25 bp, E. coli
aagaggctggctgctatgataaggc

SEQ ID NO: 220453 - DNA, 25 bp, E. coli
tttacgccagaatcgacgataagcg

SEQ ID NO: 220454 - DNA, 25 bp, E. coli
tttacgccagaaacgacgataagcg

SEQ ID NO: 220455 - DNA, 25 bp, E. coli
tctaagcaggcatgatttacgccag

SEQ ID NO: 220456 - DNA, 25 bp, E. coli
tctaagcaggcaagatttacgccag

SEQ ID NO: 220457 - DNA, 25 bp, E. coli
gcgcttccatagtaatcccctcgat

SEQ ID NO: 220458 - DNA, 25 bp, E. coli
gcgcttccatagaaatcccctcgat

SEQ ID NO: 220459 - DNA, 25 bp, E. coli
gcaagagattggctatcaagaggct

SEQ ID NO: 220460 - DNA, 25 bp, E. coli
gcaagagattgggtatcaagaggct

SEQ ID NO: 220461 - DNA, 25 bp, E. coli
gatatgatacgaaacaggactctga

SEQ ID NO: 220462 - DNA, 25 bp, E. coli
gatatgatacgatacaggactctga

SEQ ID NO: 220463 - DNA, 25 bp, E. coli
ggaagttcgatagctctacagcgaa

SEQ ID NO: 220464 - DNA, 25 bp, E. coli
ggaagttcgatacctctacagcgaa

SEQ ID NO: 220465 - DNA, 25 bp, E. coli
gatgatacttccctttgccaaatga

SEQ ID NO: 220466 - DNA, 25 bp, E. coli
gatgatacttccgtttgccaaatga

SEQ ID NO: 220467 - DNA, 25 bp, E. coli
ctctttcccagtcgcgctttgtctg

SEQ ID NO: 220468 - DNA, 25 bp, E. coli
ctctttcccagtggcgctttgtctg

SEQ ID NO: 220469 - DNA, 25 bp, E. coli
tgcgctggtgatagtgctgggtgca

SEQ ID NO: 220470 - DNA, 25 bp, E. coli
tgcgctggtgattgtgctgggtgca

SEQ ID NO: 220471 - DNA, 25 bp, E. coli
tgcctcgctgacaggcgacattttg

SEQ ID NO: 220472 - DNA, 25 bp, E. coli
tcgcgcctgcgctggtgattgtgct

SEQ ID NO: 220473 - DNA, 25 bp, E. coli
tgcctcgctgactggcgacattttg

SEQ ID NO: 220474 - DNA, 25 bp, E. coli
tcgcgcctgcgcaggtgattgtgct

SEQ ID NO: 220475 - DNA, 25 bp, E. coli
gtgctaactttgcttcacctgcttt

SEQ ID NO: 220476 - DNA, 25 bp, E. coli
gtgctaactttggttcacctgcttt

SEQ ID NO: 220477 - DNA, 25 bp, E. coli
gctgcctggtcaagttgccattcgt

SEQ ID NO: 220478 - DNA, 25 bp, E. coli
gctgcctggtcatgttgccattcgt

SEQ ID NO: 220479 - DNA, 25 bp, E. coli
gactggcgacattttgctggatgcg

SEQ ID NO: 220480 - DNA, 25 bp, E. coli
gactggcgacatattgctggatgcg

SEQ ID NO: 220481 - DNA, 25 bp, E. coli
cgctgactggcgtcattttgctgga

SEQ ID NO: 220482 - DNA, 25 bp, E. coli
cgctgactggcgacattttgctgga

SEQ ID NO: 220483 - DNA, 25 bp, E. coli
cattatctctttgccagtggcgctt

SEQ ID NO: 220484 - DNA, 25 bp, E. coli
cattatctctttcccagtggcgctt

SEQ ID NO: 220485 - DNA, 25 bp, E. coli
ggatctggttgctctcgcgcctgcg

SEQ ID NO: 220486 - DNA, 25 bp, E. coli
tggcgacattttcctggatgcgctg

SEQ ID NO: 220487 - DNA, 25 bp, E. coli
tggcgacattttgctggatgcgctg

SEQ ID NO: 220488 - DNA, 25 bp, E. coli
ggatctggttgcactcgcgcctgcg

SEQ ID NO: 220489 - DNA, 25 bp, E. coli
aggtgatttatctgacattggtcga

SEQ ID NO: 220490 - DNA, 25 bp, E. coli
atttatcagacaatggtcgatgcta

SEQ ID NO: 220491 - DNA, 25 bp, E. coli
atttatcagacattggtcgatgcta

SEQ ID NO: 220492 - DNA, 25 bp, E. coli
aggtgatttatcagacattggtcga

SEQ ID NO: 220493 - DNA, 25 bp, E. coli
tttatcagacattggtcgatgctat

SEQ ID NO: 220494 - DNA, 25 bp, E. coli
tttatcagacataggtcgatgctat

SEQ ID NO: 220495 - DNA, 25 bp, E. coli
tcgccgggtacgtcagcatgttgct

SEQ ID NO: 220496 - DNA, 25 bp, E. coli
tcgccgggtacgacagcatgttgct

SEQ ID NO: 220497 - DNA, 25 bp, E. coli
tcagacattggtggatgctattccg

SEQ ID NO: 220498 - DNA, 25 bp, E. coli
tcagacattggtcgatgctattccg

SEQ ID NO: 220499 - DNA, 25 bp, E. coli
ccggtcgccgggtacgacagcatgt

SEQ ID NO: 220500 - DNA, 25 bp, E. coli
ccggtcgccgggaacgacagcatgt

SEQ ID NO: 220501 - DNA, 25 bp, E. coli
cgccgggtacgacagcatgttgctt

SEQ ID NO: 220502 - DNA, 25 bp, E. coli
cgccgggtacgagagcatgttgctt

SEQ ID NO: 220503 - DNA, 25 bp, E. coli
cggtcgccgggttcgacagcatgtt

SEQ ID NO: 220504 - DNA, 25 bp, E. coli
cggtcgccgggtacgacagcatgtt

SEQ ID NO: 220505 - DNA, 25 bp, E. coli
gtgatttatcagacattggtcgatg

SEQ ID NO: 220506 - DNA, 25 bp, E. coli
ggtgatttatcacacattggtcgat

SEQ ID NO: 220507 - DNA, 25 bp, E. coli
gtgatttatcagtcattggtcgatg

SEQ ID NO: 220508 - DNA, 25 bp, E. coli
ggtgatttatcagacattggtcgat

SEQ ID NO: 220509 - DNA, 25 bp, E. coli
gaggtgatttatcagacattggtcg

SEQ ID NO: 220510 - DNA, 25 bp, E. coli
gaggtgatttatgagacattggtcg

SEQ ID NO: 220511 - DNA, 25 bp, E. coli
aattcgtccagagttactgggcggc

SEQ ID NO: 220512 - DNA, 25 bp, E. coli
aattcgtccagacttactgggcggc

SEQ ID NO: 220513 - DNA, 25 bp, E. coli
aataatttgcctccgcgtgatacag

SEQ ID NO: 220514 - DNA, 25 bp, E. coli
aatcagttagagatagcgacatgcc

SEQ ID NO: 220515 - DNA, 25 bp, E. coli
aatcagttagagttagcgacatgcc

SEQ ID NO: 220516 - DNA, 25 bp, E. coli
aataatttgcctgcgcgtgatacag

SEQ ID NO: 220517 - DNA, 25 bp, E. coli
caacactgtatatgacgaatgagca

SEQ ID NO: 220518 - DNA, 25 bp, E. coli
caacactgtataagacgaatgagca

SEQ ID NO: 220519 - DNA, 25 bp, E. coli
taggaaaaaatgtttcgcgtcgccg

SEQ ID NO: 220520 - DNA, 25 bp, E. coli
taggaaaaaatgattcgcgtcgccg

SEQ ID NO: 220521 - DNA, 25 bp, E. coli
cgcgtcgccgttcaggagtatatta

SEQ ID NO: 220522 - DNA, 25 bp, E. coli
ccgcagcgattagtctaggtctaga

SEQ ID NO: 220523 - DNA, 25 bp, E. coli
cgcgtcgccgttgaggagtatatta

SEQ ID NO: 220524 - DNA, 25 bp, E. coli
ccgcagcgattactctaggtctaga

SEQ ID NO: 220525 - DNA, 25 bp, E. coli
gattatccctctacggcaacactgt

SEQ ID NO: 220526 - DNA, 25 bp, E. coli
gattatccctcttcggcaacactgt

SEQ ID NO: 220527 - DNA, 25 bp, E. coli
ggtatacaaataggaaccgcagcga

SEQ ID NO: 220528 - DNA, 25 bp, E. coli
ggtatacaaatacgaaccgcagcga

SEQ ID NO: 220529 - DNA, 25 bp, E. coli
taattaaacatggatacgccgctgg

SEQ ID NO: 220530 - DNA, 25 bp, E. coli
taattaaacatgcatacgccgctgg

SEQ ID NO: 220531 - DNA, 25 bp, E. coli
gtacaattccactagcgaagttccg

SEQ ID NO: 220532 - DNA, 25 bp, E. coli
gtacaattccacaagcgaagttccg

SEQ ID NO: 220533 - DNA, 25 bp, E. coli
caaattcaatgtccagccactggga

SEQ ID NO: 220534 - DNA, 25 bp, E. coli
caaattcaatgtgcagccactggga

SEQ ID NO: 220535 - DNA, 25 bp, E. coli
aactcgtgaagaaccgttcgtcagc

SEQ ID NO: 220536 - DNA, 25 bp, E. coli
aactcgtgaagatccgttcgtcagc

SEQ ID NO: 220537 - DNA, 25 bp, E. coli
tagtacttggcggtggcgataccgc

SEQ ID NO: 220538 - DNA, 25 bp, E. coli
tagtacttggcgctggcgataccgc

SEQ ID NO: 220539 - DNA, 25 bp, E. coli
ttaatgggctttcgcgaaactcgtg

SEQ ID NO: 220540 - DNA, 25 bp, E. coli
ttaatgggctttggcgaaactcgtg

SEQ ID NO: 220541 - DNA, 25 bp, E. coli
tgtccagccactgggaattgaagtg

SEQ ID NO: 220542 - DNA, 25 bp, E. coli
tgtccagccactcggaattgaagtg

SEQ ID NO: 220543 - DNA, 25 bp, E. coli
gcggtggcgataccgcaatggactg

SEQ ID NO: 220544 - DNA, 25 bp, E. coli
gcggtggcgatagcgcaatggactg

SEQ ID NO: 220545 - DNA, 25 bp, E. coli
gctttggcgaaactcgtgaagaacc

SEQ ID NO: 220546 - DNA, 25 bp, E. coli
gctttggcgaaagtcgtgaagaacc

SEQ ID NO: 220547 - DNA, 25 bp, E. coli
gaaactcgtgaacaaccgttcgtca

SEQ ID NO: 220548 - DNA, 25 bp, E. coli
gaaactcgtgaagaaccgttcgtca

SEQ ID NO: 220549 - DNA, 25 bp, E. coli
gtacttggcggtggcgataccgcaa

SEQ ID NO: 220550 - DNA, 25 bp, E. coli
gtacttggcggtcgcgataccgcaa

SEQ ID NO: 220551 - DNA, 25 bp, E. coli
tggcgaaactcgagaagaaccgttc

SEQ ID NO: 220552 - DNA, 25 bp, E. coli
tggcgaaactcgtgaagaaccgttc

SEQ ID NO: 220553 - DNA, 25 bp, E. coli
tcaatgtccagcgactgggaattga

SEQ ID NO: 220554 - DNA, 25 bp, E. coli
tcaatgtccagccactgggaattga

SEQ ID NO: 220555 - DNA, 25 bp, E. coli
cagggcagtcacatccgtctggtgg

SEQ ID NO: 220556 - DNA, 25 bp, E. coli
cagggcagtcacttccgtctggtgg

SEQ ID NO: 220557 - DNA, 25 bp, E. coli
tacagcaatatctcactcgaagacg

SEQ ID NO: 220558 - DNA, 25 bp, E. coli
tacagcaatatcacactcgaagacg

SEQ ID NO: 220559 - DNA, 25 bp, E. coli
atatcacactcgtagacgaccaggg

SEQ ID NO: 220560 - DNA, 25 bp, E. coli
atatcacactcgaagacgaccaggg

SEQ ID NO: 220561 - DNA, 25 bp, E. coli
tttcacccggagtcaagcgcaagcg

SEQ ID NO: 220562 - DNA, 25 bp, E. coli
tttcacccggagacaagcgcaagcg

SEQ ID NO: 220563 - DNA, 25 bp, E. coli
ttaaccgctatatccgcacctcagg

SEQ ID NO: 220564 - DNA, 25 bp, E. coli
ttaaccgctataaccgcacctcagg

SEQ ID NO: 220565 - DNA, 25 bp, E. coli
tccgtctggtggttcgtgatactga

SEQ ID NO: 220566 - DNA, 25 bp, E. coli
tccgtctggtggatcgtgatactga

SEQ ID NO: 220567 - DNA, 25 bp, E. coli
tcaggcatccgtacagacacggcca

SEQ ID NO: 220568 - DNA, 25 bp, E. coli
tcaggcatccgttcagacacggcca

SEQ ID NO: 220569 - DNA, 25 bp, E. coli
gccggatgccggtgaaggtcttaac

SEQ ID NO: 220570 - DNA, 25 bp, E. coli
gccggatgccggagaaggtcttaac

SEQ ID NO: 220571 - DNA, 25 bp, E. coli
gcggtcactacctcgtacagcaata

SEQ ID NO: 220572 - DNA, 25 bp, E. coli
gcggtcactaccacgtacagcaata

SEQ ID NO: 220573 - DNA, 25 bp, E. coli
cgtgatactgaaggccggatggtct

SEQ ID NO: 220574 - DNA, 25 bp, E. coli
cgtgatactgaacgccggatggtct

SEQ ID NO: 220575 - DNA, 25 bp, E. coli
gagacaagcgcatgcggtcactacc

SEQ ID NO: 220576 - DNA, 25 bp, E. coli
gagacaagcgcaagcggtcactacc

SEQ ID NO: 220577 - DNA, 25 bp, E. coli
cagttgccggaagacaatacagtga

SEQ ID NO: 220578 - DNA, 25 bp, E. coli
cagttgccggaacacaatacagtga

SEQ ID NO: 220579 - DNA, 25 bp, E. coli
tacagtgatacacagcgtgatgcca

SEQ ID NO: 220580 - DNA, 25 bp, E. coli
tacagtgatacagagcgtgatgcca

SEQ ID NO: 220581 - DNA, 25 bp, E. coli
tgccagccctcaacagttgccggaa

SEQ ID NO: 220582 - DNA, 25 bp, E. coli
tgccagccctcatcagttgccggaa

SEQ ID NO: 220583 - DNA, 25 bp, E. coli
gccggaagacaatacagtgatacag

SEQ ID NO: 220584 - DNA, 25 bp, E. coli
gccggaagacaaaacagtgatacag

SEQ ID NO: 220585 - DNA, 25 bp, E. coli
gaagacaatacactgatacagagcg

SEQ ID NO: 220586 - DNA, 25 bp, E. coli
gaagacaatacagtgatacagagcg

SEQ ID NO: 220587 - DNA, 25 bp, E. coli
gacaatacagtgatacagagcgtga

SEQ ID NO: 220588 - DNA, 25 bp, E. coli
gacaatacagtgttacagagcgtga

SEQ ID NO: 220589 - DNA, 25 bp, E. coli
cgatggtgttaatctcattgaactg

SEQ ID NO: 220590 - DNA, 25 bp, E. coli
cgatggtgttaaactcattgaactg

SEQ ID NO: 220591 - DNA, 25 bp, E. coli
ctcattgaactgtttaacaaggtcg

SEQ ID NO: 220592 - DNA, 25 bp, E. coli
ctcattgaactgattaacaaggtcg

SEQ ID NO: 220593 - DNA, 25 bp, E. coli
gatacagagcgtgatgccattaacc

SEQ ID NO: 220594 - DNA, 25 bp, E. coli
gatacagagcgtcatgccattaacc

SEQ ID NO: 220595 - DNA, 25 bp, E. coli
gtgatgccattatccactgaaacag

SEQ ID NO: 220596 - DNA, 25 bp, E. coli
gtgatgccattaaccactgaaacag

SEQ ID NO: 220597 - DNA, 25 bp, E. coli
gagcgtgatgccattaaccactgaa

SEQ ID NO: 220598 - DNA, 25 bp, E. coli
gagcgtgatgcctttaaccactgaa

SEQ ID NO: 220599 - DNA, 25 bp, E. coli
atgggtgcgattatgtttagcgata

SEQ ID NO: 220600 - DNA, 25 bp, E. coli
atgggtgcgattttgtttagcgata

SEQ ID NO: 220601 - DNA, 25 bp, E. coli
tttgtttagcgataatggtatgttg

SEQ ID NO: 220602 - DNA, 25 bp, E. coli
tttgtttagcgaaaatggtatgttg

SEQ ID NO: 220603 - DNA, 25 bp, E. coli
tgtttagcgataatggtatgttgta

SEQ ID NO: 220604 - DNA, 25 bp, E. coli
tgggtgcgatttagtttagcgataa

SEQ ID NO: 220605 - DNA, 25 bp, E. coli
tgtttagcgatattggtatgttgta

SEQ ID NO: 220606 - DNA, 25 bp, E. coli
tgcgattttgttaagcgataatggt

SEQ ID NO: 220607 - DNA, 25 bp, E. coli
tgcgattttgtttagcgataatggt

SEQ ID NO: 220608 - DNA, 25 bp, E. coli
gcgattttgtttagcgataatggta

SEQ ID NO: 220609 - DNA, 25 bp, E. coli
gcgattttgttttgcgataatggta

SEQ ID NO: 220610 - DNA, 25 bp, E. coli
cgattttgtttagcgataatggtat

SEQ ID NO: 220611 - DNA, 25 bp, E. coli
cgattttgtttaccgataatggtat

SEQ ID NO: 220612 - DNA, 25 bp, E. coli
gtttagcgataaaggtatgttgtaa

SEQ ID NO: 220613 - DNA, 25 bp, E. coli
gtttagcgataatggtatgttgtaa

SEQ ID NO: 220614 - DNA, 25 bp, E. coli
gggtgcgattttgtttagcgataat

SEQ ID NO: 220615 - DNA, 25 bp, E. coli
gggtgcgattttctttagcgataat

SEQ ID NO: 220616 - DNA, 25 bp, E. coli
ggtgcgattttgattagcgataatg

SEQ ID NO: 220617 - DNA, 25 bp, E. coli
gtgcgattttgtttagcgataatgg

SEQ ID NO: 220618 - DNA, 25 bp, E. coli
gtgcgattttgtatagcgataatgg

SEQ ID NO: 220619 - DNA, 25 bp, E. coli
ggtgcgattttgtttagcgataatg

SEQ ID NO: 220620 - DNA, 25 bp, E. coli
tgggtgcgattttgtttagcgataa

SEQ ID NO: 220621 - DNA, 25 bp, E. coli
catacgggtgaaaggtacatggcct

SEQ ID NO: 220622 - DNA, 25 bp, E. coli
catcgtgttacacgcgtttgacccg

SEQ ID NO: 220623 - DNA, 25 bp, E. coli
cagaaacgcggatggagttctcgcc

SEQ ID NO: 220624 - DNA, 25 bp, E. coli
cagaaacgcggaaggagttctcgcc

SEQ ID NO: 220625 - DNA, 25 bp, E. coli
catacgggtgaatggtacatggcct

SEQ ID NO: 220626 - DNA, 25 bp, E. coli
catcgtgttacaggcgtttgacccg

SEQ ID NO: 220627 - DNA, 25 bp, E. coli
atggtactacctgatggccgccgag

SEQ ID NO: 220628 - DNA, 25 bp, E. coli
atggtactacctcatggccgccgag

SEQ ID NO: 220629 - DNA, 25 bp, E. coli
aaatactatatcaaccgcccgtggg

SEQ ID NO: 220630 - DNA, 25 bp, E. coli
aaatactatatctaccgcccgtggg

SEQ ID NO: 220631 - DNA, 25 bp, E. coli
aaattctggctgctctacaccgacg

SEQ ID NO: 220632 - DNA, 25 bp, E. coli
aaattctggctggtctacaccgacg

SEQ ID NO: 220633 - DNA, 25 bp, E. coli
tccaaaaatatccacgggccgtacg

SEQ ID NO: 220634 - DNA, 25 bp, E. coli
tgaaaaactggtcgctggtcagcac

SEQ ID NO: 220635 - DNA, 25 bp, E. coli
tccaaaaatatcgacgggccgtacg

SEQ ID NO: 220636 - DNA, 25 bp, E. coli
tgaaaaactggtggctggtcagcac

SEQ ID NO: 220637 - DNA, 25 bp, E. coli
gaagattgtcgactcgccgtggaaa

SEQ ID NO: 220638 - DNA, 25 bp, E. coli
gaagattgtcgagtcgccgtggaaa

SEQ ID NO: 220639 - DNA, 25 bp, E. coli
ggagctactgctttgtggactacga

SEQ ID NO: 220640 - DNA, 25 bp, E. coli
ggagctactgctatgtggactacga

SEQ ID NO: 220641 - DNA, 25 bp, E. coli
gatgctggacatcaagggcaacccg

SEQ ID NO: 220642 - DNA, 25 bp, E. coli
gatgctggacatgaagggcaacccg

SEQ ID NO: 220643 - DNA, 25 bp, E. coli
ttaaacaaccgtcgctttgcgccgc

SEQ ID NO: 220644 - DNA, 25 bp, E. coli
ttaaacaaccgtggctttgcgccgc

SEQ ID NO: 220645 - DNA, 25 bp, E. coli
tgaaatcctggtacttcctgccgcc

SEQ ID NO: 220646 - DNA, 25 bp, E. coli
tgaaatcctggttcttcctgccgcc

SEQ ID NO: 220647 - DNA, 25 bp, E. coli
tgacttacgcttaccagagctggcg

SEQ ID NO: 220648 - DNA, 25 bp, E. coli
tgacttacgctttccagagctggcg

SEQ ID NO: 220649 - DNA, 25 bp, E. coli
tctgatgacctgatatgacttacgc

SEQ ID NO: 220650 - DNA, 25 bp, E. coli
tctgatgacctgttatgacttacgc

SEQ ID NO: 220651 - DNA, 25 bp, E. coli
gctcgtgcgctggataccacctgtt

SEQ ID NO: 220652 - DNA, 25 bp, E. coli
gctcgtgcgctgcataccacctgtt

SEQ ID NO: 220653 - DNA, 25 bp, E. coli
gcaggaaacatcgtcgcccgttatg

SEQ ID NO: 220654 - DNA, 25 bp, E. coli
gcaggaaacatcctcgcccgttatg

SEQ ID NO: 220655 - DNA, 25 bp, E. coli
gaaatgcctgcactcattatggcgg

SEQ ID NO: 220656 - DNA, 25 bp, E. coli
gaaatgcctgcagtcattatggcgg

SEQ ID NO: 220657 - DNA, 25 bp, E. coli
cattatggcggatgtgacgcccgaa

SEQ ID NO: 220658 - DNA, 25 bp, E. coli
cattatggcggaagtgacgcccgaa

SEQ ID NO: 220659 - DNA, 25 bp, E. coli
gattatagatccgtttggcgtcacc

SEQ ID NO: 220660 - DNA, 25 bp, E. coli
gattatagatccctttggcgtcacc

SEQ ID NO: 220661 - DNA, 25 bp, E. coli
tggtcaacgttgcttgccgctcgtg

SEQ ID NO: 220662 - DNA, 25 bp, E. coli
tggtcaacgttggttgccgctcgtg

SEQ ID NO: 220663 - DNA, 25 bp, E. coli
tcaccattgcggcagcgtcagaaat

SEQ ID NO: 220664 - DNA, 25 bp, E. coli
tcaccattgcgggagcgtcagaaat

SEQ ID NO: 220665 - DNA, 25 bp, E. coli
tatatttcctgttacgacggcggtc

SEQ ID NO: 220666 - DNA, 25 bp, E. coli
tatatttcctgtaacgacggcggtc

SEQ ID NO: 220667 - DNA, 25 bp, E. coli
ttgtcccggcggtagatttagaccg

SEQ ID NO: 220668 - DNA, 25 bp, E. coli
ttttatcgccaacgaagtctcgccg

SEQ ID NO: 220669 - DNA, 25 bp, E. coli
ttttatcgccaaggaagtctcgccg

SEQ ID NO: 220670 - DNA, 25 bp, E. coli
ttgtcccggcggaagatttagaccg

SEQ ID NO: 220671 - DNA, 25 bp, E. coli
tccgttggaagagaatctggccgcc

SEQ ID NO: 220672 - DNA, 25 bp, E. coli
tccgttggaagacaatctggccgcc

SEQ ID NO: 220673 - DNA, 25 bp, E. coli
gacttctcatgccatgggtagcgat

SEQ ID NO: 220674 - DNA, 25 bp, E. coli
gacttctcatgcgatgggtagcgat

SEQ ID NO: 220675 - DNA, 25 bp, E. coli
cccggagctggtagaaaaatattgt

SEQ ID NO: 220676 - DNA, 25 bp, E. coli
cccggagctggttgaaaaatattgt

SEQ ID NO: 220677 - DNA, 25 bp, E. coli
gtatcggcggcattgaaacctggga

SEQ ID NO: 220678 - DNA, 25 bp, E. coli
gtatcggcggcaatgaaacctggga

SEQ ID NO: 220679 - DNA, 25 bp, E. coli
ggcattgcggcgtttaacaccgtta

SEQ ID NO: 220680 - DNA, 25 bp, E. coli
tggaatggagcgagaaaacccgcac

SEQ ID NO: 220681 - DNA, 25 bp, E. coli
ggcattgcggcgattaacaccgtta

SEQ ID NO: 220682 - DNA, 25 bp, E. coli
tggaatggagcgtgaaaacccgcac

SEQ ID NO: 220683 - DNA, 25 bp, E. coli
taagaaaggcgagaaagaacacccg

SEQ ID NO: 220684 - DNA, 25 bp, E. coli
taagaaaggcgacaaagaacacccg

SEQ ID NO: 220685 - DNA, 25 bp, E. coli
gagtgtaacttcacctgtccgcaaa

SEQ ID NO: 220686 - DNA, 25 bp, E. coli
gagtgtaacttctcctgtccgcaaa

SEQ ID NO: 220687 - DNA, 25 bp, E. coli
cagctgcagacgttggtggcacaac

SEQ ID NO: 220688 - DNA, 25 bp, E. coli
caaaatatctgctggctccggaagt

SEQ ID NO: 220689 - DNA, 25 bp, E. coli
caactgaaaatagccatggagcggc

SEQ ID NO: 220690 - DNA, 25 bp, E. coli
caaaatatctgcaggctccggaagt

SEQ ID NO: 220691 - DNA, 25 bp, E. coli
caactgaaaatacccatggagcggc

SEQ ID NO: 220692 - DNA, 25 bp, E. coli
cagctgcagacgatggtggcacaac

SEQ ID NO: 220693 - DNA, 25 bp, E. coli
aacaacggaccgtaaaagctgccag

SEQ ID NO: 220694 - DNA, 25 bp, E. coli
aacaacggaccgaaaaagctgccag

SEQ ID NO: 220695 - DNA, 25 bp, E. coli
tatgcgatgcacatgctgtatgccg

SEQ ID NO: 220696 - DNA, 25 bp, E. coli
tatccgtttgtggagcttgcgaccc

SEQ ID NO: 220697 - DNA, 25 bp, E. coli
tatccgtttgtgcagcttgcgaccc

SEQ ID NO: 220698 - DNA, 25 bp, E. coli
tatgcgatgcacttgctgtatgccg

SEQ ID NO: 220699 - DNA, 25 bp, E. coli
tctgcaaagcctgatgggacataag

SEQ ID NO: 220700 - DNA, 25 bp, E. coli
tctgcaaagcctcatgggacataag

SEQ ID NO: 220701 - DNA, 25 bp, E. coli
ccggtataccgctgaaagttctgca

SEQ ID NO: 220702 - DNA, 25 bp, E. coli
ccggtataccgcagaaagttctgca

SEQ ID NO: 220703 - DNA, 25 bp, E. coli
gatctgcaccgctagatgctgctgg

SEQ ID NO: 220704 - DNA, 25 bp, E. coli
tggaacaccggagcacgcattaatg

SEQ ID NO: 220705 - DNA, 25 bp, E. coli
tggaacaccggaccacgcattaatg

SEQ ID NO: 220706 - DNA, 25 bp, E. coli
taaccgtcgcacaggaaggacagag

SEQ ID NO: 220707 - DNA, 25 bp, E. coli
taaccgtcgcactggaaggacagag

SEQ ID NO: 220708 - DNA, 25 bp, E. coli
gatctgcaccgcaagatgctgctgg

SEQ ID NO: 220709 - DNA, 25 bp, E. coli
cataacgcactggacgaatgcagca

SEQ ID NO: 220710 - DNA, 25 bp, E. coli
cataacgcactgcacgaatgcagca

SEQ ID NO: 220711 - DNA, 25 bp, E. coli
atgaagtatttatccatcttaatcc

SEQ ID NO: 220712 - DNA, 25 bp, E. coli
atgaagtatttaaccatcttaatcc

SEQ ID NO: 220713 - DNA, 25 bp, E. coli
actggaaactgcacgggaagcaaaa

SEQ ID NO: 220714 - DNA, 25 bp, E. coli
aaaaagatggcaacaatccataacg

SEQ ID NO: 220715 - DNA, 25 bp, E. coli
actggaaactgctcgggaagcaaaa

SEQ ID NO: 220716 - DNA, 25 bp, E. coli
aaaatattctctggacgtagcgctg

SEQ ID NO: 220717 - DNA, 25 bp, E. coli
aaaaagatggcatcaatccataacg

SEQ ID NO: 220718 - DNA, 25 bp, E. coli
aaaatattctctcgacgtagcgctg

SEQ ID NO: 220719 - DNA, 25 bp, E. coli
tagcgctgcacagcgggacaggtta

SEQ ID NO: 220720 - DNA, 25 bp, E. coli
tagcgctgcacaccgggacaggtta

SEQ ID NO: 220721 - DNA, 25 bp, E. coli
tattctctggacctagcgctgcaca

SEQ ID NO: 220722 - DNA, 25 bp, E. coli
tattctctggacgtagcgctgcaca

SEQ ID NO: 220723 - DNA, 25 bp, E. coli
tgccccgcctaatgataaaaagatg

SEQ ID NO: 220724 - DNA, 25 bp, E. coli
tgccccgcctaaagataaaaagatg

SEQ ID NO: 220725 - DNA, 25 bp, E. coli
gaagcaaaaacgaggggtcacgccg

SEQ ID NO: 220726 - DNA, 25 bp, E. coli
gaagcaaaaacgtggggtcacgccg

SEQ ID NO: 220727 - DNA, 25 bp, E. coli
gtcacgccggaacaaaatgaaaaat

SEQ ID NO: 220728 - DNA, 25 bp, E. coli
gtcacgccggaagaaaatgaaaaat

SEQ ID NO: 220729 - DNA, 25 bp, E. coli
cgcactggacgattgcagcacagag

SEQ ID NO: 220730 - DNA, 25 bp, E. coli
cgcactggacgaatgcagcacagag

SEQ ID NO: 220731 - DNA, 25 bp, E. coli
cagcaattgcgcttgaaaaaccata

SEQ ID NO: 220732 - DNA, 25 bp, E. coli
cataccttgcagacgggcattgaaa

SEQ ID NO: 220733 - DNA, 25 bp, E. coli
cagcaattgcgcatgaaaaaccata

SEQ ID NO: 220734 - DNA, 25 bp, E. coli
cataccttgcagtcgggcattgaaa

SEQ ID NO: 220735 - DNA, 25 bp, E. coli
acttaatgcgccagcaattgcgctt

SEQ ID NO: 220736 - DNA, 25 bp, E. coli
acttaatgcgcctgcaattgcgctt

SEQ ID NO: 220737 - DNA, 25 bp, E. coli
ttgcagtcgggctttgaaacggcgt

SEQ ID NO: 220738 - DNA, 25 bp, E. coli
ttgcagtcgggcattgaaacggcgt

SEQ ID NO: 220739 - DNA, 25 bp, E. coli
tgtgtaccgctggacgaacttacgc

SEQ ID NO: 220740 - DNA, 25 bp, E. coli
tgtgtaccgctgcacgaacttacgc

SEQ ID NO: 220741 - DNA, 25 bp, E. coli
tgaaggccgggttctgaattttgac

SEQ ID NO: 220742 - DNA, 25 bp, E. coli
tgaaacggcgtgtgtaccgctggac

SEQ ID NO: 220743 - DNA, 25 bp, E. coli
tgaaacggcgtgagtaccgctggac

SEQ ID NO: 220744 - DNA, 25 bp, E. coli
tgaaggccgggtactgaattttgac

SEQ ID NO: 220745 - DNA, 25 bp, E. coli
tcgggcattgaaacggcgtgtgtac

SEQ ID NO: 220746 - DNA, 25 bp, E. coli
tcgggcattgaatcggcgtgtgtac

SEQ ID NO: 220747 - DNA, 25 bp, E. coli
gaaatcactattcaaggccgggtac

SEQ ID NO: 220748 - DNA, 25 bp, E. coli
gaaatcactattgaaggccgggtac

SEQ ID NO: 220749 - DNA, 25 bp, E. coli
cgcgatgcgtcatcgtgtctgcggt

SEQ ID NO: 220750 - DNA, 25 bp, E. coli
cgcgatgcgtcaacgtgtctgcggt

SEQ ID NO: 220751 - DNA, 25 bp, E. coli
cgtgtctgcggtagaccaatgaagg

SEQ ID NO: 220752 - DNA, 25 bp, E. coli
cgtgtctgcggttgaccaatgaagg

SEQ ID NO: 220753 - DNA, 25 bp, E. coli
accgtgggggcagcccgcgctttgt

SEQ ID NO: 220754 - DNA, 25 bp, E. coli
accgtgggggcaccccgcgctttgt

SEQ ID NO: 220755 - DNA, 25 bp, E. coli
aacattggctggtccatcggtccgc

SEQ ID NO: 220756 - DNA, 25 bp, E. coli
aacattggctggaccatcggtccgc

SEQ ID NO: 220757 - DNA, 25 bp, E. coli
acattggctggaccatcggtccgcc

SEQ ID NO: 220758 - DNA, 25 bp, E. coli
acattggctggagcatcggtccgcc

SEQ ID NO: 220759 - DNA, 25 bp, E. coli
tccgcccagtctttaggctggcttg

SEQ ID NO: 220760 - DNA, 25 bp, E. coli
tccgcccagtctataggctggcttg

SEQ ID NO: 220761 - DNA, 25 bp, E. coli
tctggctggcagctatctgttccgc

SEQ ID NO: 220762 - DNA, 25 bp, E. coli
tctggctggcaggtatctgttccgc

SEQ ID NO: 220763 - DNA, 25 bp, E. coli
gcccttctggctcgcagctatctgt

SEQ ID NO: 220764 - DNA, 25 bp, E. coli
ccttctggctggcagctatctgttc

SEQ ID NO: 220765 - DNA, 25 bp, E. coli
gcccagtctttacgctggcttggtg

SEQ ID NO: 220766 - DNA, 25 bp, E. coli
gcccagtctttaggctggcttggtg

SEQ ID NO: 220767 - DNA, 25 bp, E. coli
ccttctggctgggagctatctgttc

SEQ ID NO: 220768 - DNA, 25 bp, E. coli
gcccttctggctggcagctatctgt

SEQ ID NO: 220769 - DNA, 25 bp, E. coli
cgcccagtcttttggctggcttggt

SEQ ID NO: 220770 - DNA, 25 bp, E. coli
cgcccagtctttaggctggcttggt

SEQ ID NO: 220771 - DNA, 25 bp, E. coli
ggctggcagctaactgttccgcgtt

SEQ ID NO: 220772 - DNA, 25 bp, E. coli
ggctggcagctatctgttccgcgtt

SEQ ID NO: 220773 - DNA, 25 bp, E. coli
tggctggcagctttctgttccgcgt

SEQ ID NO: 220774 - DNA, 25 bp, E. coli
tggctggcagctatctgttccgcgt

SEQ ID NO: 220775 - DNA, 25 bp, E. coli
caacatatggtgtttgggcgcgccc

SEQ ID NO: 220776 - DNA, 25 bp, E. coli
caacatatggtgattgggcgcgccc

SEQ ID NO: 220777 - DNA, 25 bp, E. coli
acaatctggattttgggagcctgca

SEQ ID NO: 220778 - DNA, 25 bp, E. coli
acaatctggattatgggagcctgca

SEQ ID NO: 220779 - DNA, 25 bp, E. coli
tatttaatccgggaaccccgatcga

SEQ ID NO: 220780 - DNA, 25 bp, E. coli
tatttaatccggcaaccccgatcga

SEQ ID NO: 220781 - DNA, 25 bp, E. coli
tgagctgacggctttggacaatctg

SEQ ID NO: 220782 - DNA, 25 bp, E. coli
tgagctgacggcattggacaatctg

SEQ ID NO: 220783 - DNA, 25 bp, E. coli
gcgcacgagccggactggtatttaa

SEQ ID NO: 220784 - DNA, 25 bp, E. coli
gcgcacgagccgcactggtatttaa

SEQ ID NO: 220785 - DNA, 25 bp, E. coli
gaaaatccaaaaagtacgcacggct

SEQ ID NO: 220786 - DNA, 25 bp, E. coli
gaaacgttaactcagatccgccata

SEQ ID NO: 220787 - DNA, 25 bp, E. coli
gaaacgctggactatccttcggaaa

SEQ ID NO: 220788 - DNA, 25 bp, E. coli
gaaacgctggacaatccttcggaaa

SEQ ID NO: 220789 - DNA, 25 bp, E. coli
gaaaatccaaaatgtacgcacggct

SEQ ID NO: 220790 - DNA, 25 bp, E. coli
gaaacgttaactgagatccgccata

SEQ ID NO: 220791 - DNA, 25 bp, E. coli
ccgacggtggaaatacgctggcagc

SEQ ID NO: 220792 - DNA, 25 bp, E. coli
ccgacggtggaattacgctggcagc

SEQ ID NO: 220793 - DNA, 25 bp, E. coli
tggctgaaatcagacccgcgtggat

SEQ ID NO: 220794 - DNA, 25 bp, E. coli
tggctgaaatcacacccgcgtggat

SEQ ID NO: 220795 - DNA, 25 bp, E. coli
ggcttttcctcacaccgagtgctgg

SEQ ID NO: 220796 - DNA, 25 bp, E. coli
ggcttttcctcagaccgagtgctgg

SEQ ID NO: 220797 - DNA, 25 bp, E. coli
aatcagttccgtacttttgctcgcg

SEQ ID NO: 220798 - DNA, 25 bp, E. coli
aatcagttccgttcttttgctcgcg

SEQ ID NO: 220799 - DNA, 25 bp, E. coli
cactggaggagcatcgtcgtcttaa

SEQ ID NO: 220800 - DNA, 25 bp, E. coli
cactggaggagcttcgtcgtcttaa

SEQ ID NO: 220801 - DNA, 25 bp, E. coli
tttgctcgcggctttgataacgtgc

SEQ ID NO: 220802 - DNA, 25 bp, E. coli
tttgctcgcggcattgataacgtgc

SEQ ID NO: 220803 - DNA, 25 bp, E. coli
tgcgaatggcgaaaacacgctggag

SEQ ID NO: 220804 - DNA, 25 bp, E. coli
tgcgaatggcgataacacgctggag

SEQ ID NO: 220805 - DNA, 25 bp, E. coli
tgccgtaccgcctgcgaatggcgaa

SEQ ID NO: 220806 - DNA, 25 bp, E. coli
tgccgtaccgccagcgaatggcgaa

SEQ ID NO: 220807 - DNA, 25 bp, E. coli
ccatgagcaacaaaatgccgtaccg

SEQ ID NO: 220808 - DNA, 25 bp, E. coli
ccatgagcaacataatgccgtaccg

SEQ ID NO: 220809 - DNA, 25 bp, E. coli
gcaacaacctcgcagaaaagccatg

SEQ ID NO: 220810 - DNA, 25 bp, E. coli
gcaacaacctcggagaaaagccatg

SEQ ID NO: 220811 - DNA, 25 bp, E. coli
gaactggatgttgcggcaacaacct

SEQ ID NO: 220812 - DNA, 25 bp, E. coli
gaaaacacgctgcagaatcaaatag

SEQ ID NO: 220813 - DNA, 25 bp, E. coli
gaactggatgttccggcaacaacct

SEQ ID NO: 220814 - DNA, 25 bp, E. coli
gaaaacacgctggagaatcaaatag

SEQ ID NO: 220815 - DNA, 25 bp, E. coli
taatcgcttcggaatttcactggag

SEQ ID NO: 220816 - DNA, 25 bp, E. coli
taacgtgcgccacggtgaagaactg

SEQ ID NO: 220817 - DNA, 25 bp, E. coli
taatcgcttcggtatttcactggag

SEQ ID NO: 220818 - DNA, 25 bp, E. coli
taacgtgcgccagggtgaagaactg

SEQ ID NO: 220819 - DNA, 25 bp, E. coli
caacgtactggtcaagaaagtgcgt

SEQ ID NO: 220820 - DNA, 25 bp, E. coli
caacgtactggtgaagaaagtgcgt

SEQ ID NO: 220821 - DNA, 25 bp, E. coli
actggtgaagaatgtgcgttatctc

SEQ ID NO: 220822 - DNA, 25 bp, E. coli
actggtgaagaaagtgcgttatctc

SEQ ID NO: 220823 - DNA, 25 bp, E. coli
gcaagatcacaataatgatgaacgg

SEQ ID NO: 220824 - DNA, 25 bp, E. coli
gaagaaagtgcgatatctcaaagat

SEQ ID NO: 220825 - DNA, 25 bp, E. coli
gaagctaatttaatcctggcttaaa

SEQ ID NO: 220826 - DNA, 25 bp, E. coli
gaagaaagtgcgttatctcaaagat

SEQ ID NO: 220827 - DNA, 25 bp, E. coli
gcaagatcacaaaaatgatgaacgg

SEQ ID NO: 220828 - DNA, 25 bp, E. coli
gaagctaatttattcctggcttaaa

SEQ ID NO: 220829 - DNA, 25 bp, E. coli
gaacgggaagctaatttattcctgg

SEQ ID NO: 220830 - DNA, 25 bp, E. coli
gaacgggaagcttatttattcctgg

SEQ ID NO: 220831 - DNA, 25 bp, E. coli
gaaagtgcgttaactcaaagatgtg

SEQ ID NO: 220832 - DNA, 25 bp, E. coli
gaaagtgcgttatctcaaagatgtg

SEQ ID NO: 220833 - DNA, 25 bp, E. coli
cgtactggtgaagaaagtgcgttat

SEQ ID NO: 220834 - DNA, 25 bp, E. coli
cgtactggtgaacaaagtgcgttat

SEQ ID NO: 220835 - DNA, 25 bp, E. coli
gatcacaaaaatgatgaacgggaag

SEQ ID NO: 220836 - DNA, 25 bp, E. coli
gatcacaaaaatcatgaacgggaag

SEQ ID NO: 220837 - DNA, 25 bp, E. coli
gttgcaatcttctgctgacaaagcg

SEQ ID NO: 220838 - DNA, 25 bp, E. coli
gttgcaatcttcagctgacaaagcg

SEQ ID NO: 220839 - DNA, 25 bp, E. coli
gatgaacgggaacctaatttattcc

SEQ ID NO: 220840 - DNA, 25 bp, E. coli
gatgaacgggaagctaatttattcc

SEQ ID NO: 220841 - DNA, 25 bp, E. coli
caacggcgcacaacaagcgggtaaa

SEQ ID NO: 220842 - DNA, 25 bp, E. coli
caatctctatgaatgtgcaggccgc

SEQ ID NO: 220843 - DNA, 25 bp, E. coli
caatctctatgattgtgcaggccgc

SEQ ID NO: 220844 - DNA, 25 bp, E. coli
caacggcgcacatcaagcgggtaaa

SEQ ID NO: 220845 - DNA, 25 bp, E. coli
taaaagcgtatagcgatctcgacgc

SEQ ID NO: 220846 - DNA, 25 bp, E. coli
tacttagcgctcttggcattgccgc

SEQ ID NO: 220847 - DNA, 25 bp, E. coli
tacttagcgctcatggcattgccgc

SEQ ID NO: 220848 - DNA, 25 bp, E. coli
taaaagcgtataccgatctcgacgc

SEQ ID NO: 220849 - DNA, 25 bp, E. coli
agagctgggcgtagatgtgacctac

SEQ ID NO: 220850 - DNA, 25 bp, E. coli
agagctgggcgttgatgtgacctac

SEQ ID NO: 220851 - DNA, 25 bp, E. coli
taccggagcgcgagatattcaacaa

SEQ ID NO: 220852 - DNA, 25 bp, E. coli
taccggagcgcgtgatattcaacaa

SEQ ID NO: 220853 - DNA, 25 bp, E. coli
tgaaacgcgccaagcaacgtggtgt

SEQ ID NO: 220854 - DNA, 25 bp, E. coli
tgaaacgcgccatgcaacgtggtgt

SEQ ID NO: 220855 - DNA, 25 bp, E. coli
tgatggcttgtgaccggcactgaaa

SEQ ID NO: 220856 - DNA, 25 bp, E. coli
tgatggcttgtgtccggcactgaaa

SEQ ID NO: 220857 - DNA, 25 bp, E. coli
tctgatactaaagcggagtgccgct

SEQ ID NO: 220858 - DNA, 25 bp, E. coli
tctgatactaaaccggagtgccgct

SEQ ID NO: 220859 - DNA, 25 bp, E. coli
cgattgtcggatacagtacgccaaa

SEQ ID NO: 220860 - DNA, 25 bp, E. coli
cgattgtcggattcagtacgccaaa

SEQ ID NO: 220861 - DNA, 25 bp, E. coli
taatggcatcgtactgttaccggag

SEQ ID NO: 220862 - DNA, 25 bp, E. coli
taatggcatcgttctgttaccggag

SEQ ID NO: 220863 - DNA, 25 bp, E. coli
caacggatttggttttggcccgaat

SEQ ID NO: 220864 - DNA, 25 bp, E. coli
caacggatttggatttggcccgaat

SEQ ID NO: 220865 - DNA, 25 bp, E. coli
aagtgctgccatccgccaagttgac

SEQ ID NO: 220866 - DNA, 25 bp, E. coli
aagtgctgccatgcgccaagttgac

SEQ ID NO: 220867 - DNA, 25 bp, E. coli
cagtggcaaaaatgacaatccgggc

SEQ ID NO: 220868 - DNA, 25 bp, E. coli
cagtggcaaaaaagacaatccgggc

SEQ ID NO: 220869 - DNA, 25 bp, E. coli
ttagcagacagaacaatcacgctgg

SEQ ID NO: 220870 - DNA, 25 bp, E. coli
ttagcagacagatcaatcacgctgg

SEQ ID NO: 220871 - DNA, 25 bp, E. coli
tcgactatggcaaacgaagtgctgc

SEQ ID NO: 220872 - DNA, 25 bp, E. coli
tcgactatggcatacgaagtgctgc

SEQ ID NO: 220873 - DNA, 25 bp, E. coli
ccatggccgctcaggcagagtgtaa

SEQ ID NO: 220874 - DNA, 25 bp, E. coli
ccatggccgctctggcagagtgtaa

SEQ ID NO: 220875 - DNA, 25 bp, E. coli
gcacaggaacaggatcaattaggga

SEQ ID NO: 220876 - DNA, 25 bp, E. coli
gcacaggaacagcatcaattaggga

SEQ ID NO: 220877 - DNA, 25 bp, E. coli
gaaacggataataacaggatgcctg

SEQ ID NO: 220878 - DNA, 25 bp, E. coli
gaaacggataattacaggatgcctg

SEQ ID NO: 220879 - DNA, 25 bp, E. coli
ggtagtaacaatctcgacctggcgt

SEQ ID NO: 220880 - DNA, 25 bp, E. coli
ggtagtaacaatgtcgacctggcgt

SEQ ID NO: 220881 - DNA, 25 bp, E. coli
taatgcaatgcgatcaggacgctca

SEQ ID NO: 220882 - DNA, 25 bp, E. coli
taatgcaatgcgttcaggacgctca

SEQ ID NO: 220883 - DNA, 25 bp, E. coli
gatgcctgctgctgaacttcgccat

SEQ ID NO: 220884 - DNA, 25 bp, E. coli
gatgcctgctgcagaacttcgccat

SEQ ID NO: 220885 - DNA, 25 bp, E. coli
ctacagccgttgccgaacgtaggcc

SEQ ID NO: 220886 - DNA, 25 bp, E. coli
agccgttgccgatcgtaggccggat

SEQ ID NO: 220887 - DNA, 25 bp, E. coli
atcatgcctacagccgttgccgaac

SEQ ID NO: 220888 - DNA, 25 bp, E. coli
atgcctacagccgttgccgaacgta

SEQ ID NO: 220889 - DNA, 25 bp, E. coli
atgcctacagcccttgccgaacgta

SEQ ID NO: 220890 - DNA, 25 bp, E. coli
acagccgttgccgaacgtaggccgg

SEQ ID NO: 220891 - DNA, 25 bp, E. coli
acagccgttgcccaacgtaggccgg

SEQ ID NO: 220892 - DNA, 25 bp, E. coli
agccgttgccgaacgtaggccggat

SEQ ID NO: 220893 - DNA, 25 bp, E. coli
ctacagccgttggcgaacgtaggcc

SEQ ID NO: 220894 - DNA, 25 bp, E. coli
atcatgcctacacccgttgccgaac

SEQ ID NO: 220895 - DNA, 25 bp, E. coli
cagccgttgccgtacgtaggccgga

SEQ ID NO: 220896 - DNA, 25 bp, E. coli
cagccgttgccgaacgtaggccgga

SEQ ID NO: 220897 - DNA, 25 bp, E. coli
tatcatgcctactgccgttgccgaa

SEQ ID NO: 220898 - DNA, 25 bp, E. coli
tatcatgcctacagccgttgccgaa

SEQ ID NO: 220899 - DNA, 25 bp, E. coli
ttatcatgcctacagccgttgccga

SEQ ID NO: 220900 - DNA, 25 bp, E. coli
ttatcatgcctagagccgttgccga

SEQ ID NO: 220901 - DNA, 25 bp, E. coli
tgcctacagccgatgccgaacgtag

SEQ ID NO: 220902 - DNA, 25 bp, E. coli
tgcctacagccgttgccgaacgtag

SEQ ID NO: 220903 - DNA, 25 bp, E. coli
gcctacagccgttgccgaacgtagg

SEQ ID NO: 220904 - DNA, 25 bp, E. coli
gcctacagccgtagccgaacgtagg

SEQ ID NO: 220905 - DNA, 25 bp, E. coli
cctacagccgttgccgaacgtaggc

SEQ ID NO: 220906 - DNA, 25 bp, E. coli
cctacagccgttcccgaacgtaggc

SEQ ID NO: 220907 - DNA, 25 bp, E. coli
attttgctgccacgttaccgcgccg

SEQ ID NO: 220908 - DNA, 25 bp, E. coli
attttgctgccaggttaccgcgccg

SEQ ID NO: 220909 - DNA, 25 bp, E. coli
tatgcgtagccggatgctcagtatg

SEQ ID NO: 220910 - DNA, 25 bp, E. coli
tatgcgtagccgcatgctcagtatg

SEQ ID NO: 220911 - DNA, 25 bp, E. coli
tttagcggcctagtcgcgccgttgc

SEQ ID NO: 220912 - DNA, 25 bp, E. coli
tttagcggcctactcgcgccgttgc

SEQ ID NO: 220913 - DNA, 25 bp, E. coli
tgtgggcatcctgctactgatggcg

SEQ ID NO: 220914 - DNA, 25 bp, E. coli
tgtgggcatcctcctactgatggcg

SEQ ID NO: 220915 - DNA, 25 bp, E. coli
tgcaatggctgaaaatatgcgtagc

SEQ ID NO: 220916 - DNA, 25 bp, E. coli
tgcaatggctgataatatgcgtagc

SEQ ID NO: 220917 - DNA, 25 bp, E. coli
tgctggcacggatttctggagctgc

SEQ ID NO: 220918 - DNA, 25 bp, E. coli
tgctggcacggaattctggagctgc

SEQ ID NO: 220919 - DNA, 25 bp, E. coli
tctattggctgttcccgcccttggg

SEQ ID NO: 220920 - DNA, 25 bp, E. coli
tctattggctgtacccgcccttggg

SEQ ID NO: 220921 - DNA, 25 bp, E. coli
ccttgggcgacaactatcgtgctga

SEQ ID NO: 220922 - DNA, 25 bp, E. coli
ccttgggcgacatctatcgtgctga

SEQ ID NO: 220923 - DNA, 25 bp, E. coli
gctgatcctgtttgtgggcatcctg

SEQ ID NO: 220924 - DNA, 25 bp, E. coli
gctgatcctgttagtgggcatcctg

SEQ ID NO: 220925 - DNA, 25 bp, E. coli
gactgtccgcctgcagtctattggc

SEQ ID NO: 220926 - DNA, 25 bp, E. coli
gactgtccgcctccagtctattggc

SEQ ID NO: 220927 - DNA, 25 bp, E. coli
cgatatgccagggatgcttaataaa

SEQ ID NO: 220928 - DNA, 25 bp, E. coli
cgatatgccaggcatgcttaataaa

SEQ ID NO: 220929 - DNA, 25 bp, E. coli
catcctgattatagactaagtgcgc

SEQ ID NO: 220930 - DNA, 25 bp, E. coli
catcctgattattgactaagtgcgc

SEQ ID NO: 220931 - DNA, 25 bp, E. coli
attattgactaactgcgcgttgttc

SEQ ID NO: 220932 - DNA, 25 bp, E. coli
attattgactaagtgcgcgttgttc

SEQ ID NO: 220933 - DNA, 25 bp, E. coli
ctcgcccttttttattctgaggtgc

SEQ ID NO: 220934 - DNA, 25 bp, E. coli
ctcgccctttttaattctgaggtgc

SEQ ID NO: 220935 - DNA, 25 bp, E. coli
aaaatattgcaggagttatgtaggc

SEQ ID NO: 220936 - DNA, 25 bp, E. coli
aaaatattgcagcagttatgtaggc

SEQ ID NO: 220937 - DNA, 25 bp, E. coli
tagggtgagggaaaacctcgccctt

SEQ ID NO: 220938 - DNA, 25 bp, E. coli
tagggtgagggataacctcgccctt

SEQ ID NO: 220939 - DNA, 25 bp, E. coli
tgcgtttagggtgagggataacctc

SEQ ID NO: 220940 - DNA, 25 bp, E. coli
tgcgtttagggtcagggataacctc

SEQ ID NO: 220941 - DNA, 25 bp, E. coli
gcatcaggcattaatgcgtttaggg

SEQ ID NO: 220942 - DNA, 25 bp, E. coli
gcatcaggcatttatgcgtttaggg

SEQ ID NO: 220943 - DNA, 25 bp, E. coli
cgtttttacggaaatgacagggtga

SEQ ID NO: 220944 - DNA, 25 bp, E. coli
cgtttttacggatatgacagggtga

SEQ ID NO: 220945 - DNA, 25 bp, E. coli
gatattctgtatgccgtttttacgg

SEQ ID NO: 220946 - DNA, 25 bp, E. coli
gatattctgtatcccgtttttacgg

SEQ ID NO: 220947 - DNA, 25 bp, E. coli
gggtaacctcacatcctgattattg

SEQ ID NO: 220948 - DNA, 25 bp, E. coli
gggtaacctcacttcctgattattg

SEQ ID NO: 220949 - DNA, 25 bp, E. coli
ggcctacaaatcatgcaaatccaaa

SEQ ID NO: 220950 - DNA, 25 bp, E. coli
ggcctacaaatcttgcaaatccaaa

SEQ ID NO: 220951 - DNA, 25 bp, E. coli
caaggcgggcgtaatcagctcatca

SEQ ID NO: 220952 - DNA, 25 bp, E. coli
caaggcgggcgttatcagctcatca

SEQ ID NO: 220953 - DNA, 25 bp, E. coli
tactcggtatggaaatgcgcctttc

SEQ ID NO: 220954 - DNA, 25 bp, E. coli
tactcggtatggtaatgcgcctttc

SEQ ID NO: 220955 - DNA, 25 bp, E. coli
aaagttttcatcgtgctggagcgcc

SEQ ID NO: 220956 - DNA, 25 bp, E. coli
aaagttttcatcctgctggagcgcc

SEQ ID NO: 220957 - DNA, 25 bp, E. coli
ttcgcgggcgcttcaaagtggcagt

SEQ ID NO: 220958 - DNA, 25 bp, E. coli
ttcgcgggcgctacaaagtggcagt

SEQ ID NO: 220959 - DNA, 25 bp, E. coli
tgaatccgatgatcgacgcggcgac

SEQ ID NO: 220960 - DNA, 25 bp, E. coli
tgaatccgatgaacgacgcggcgac

SEQ ID NO: 220961 - DNA, 25 bp, E. coli
gaatttgagcagatctaccgccgtc

SEQ ID NO: 220962 - DNA, 25 bp, E. coli
gaatttgagcagttctaccgccgtc

SEQ ID NO: 220963 - DNA, 25 bp, E. coli
gacagatgttcacgccgtggagcaa

SEQ ID NO: 220964 - DNA, 25 bp, E. coli
gacagatgttcaggccgtggagcaa

SEQ ID NO: 220965 - DNA, 25 bp, E. coli
cgtttattgatgtagcggcgctcgg

SEQ ID NO: 220966 - DNA, 25 bp, E. coli
cgtttattgatgaagcggcgctcgg

SEQ ID NO: 220967 - DNA, 25 bp, E. coli
tgcttcaggaactgggctacgaacc

SEQ ID NO: 220968 - DNA, 25 bp, E. coli
tgcttcaggaacagggctacgaacc

SEQ ID NO: 220969 - DNA, 25 bp, E. coli
ggatacgacgaataaagcctgcgcg

SEQ ID NO: 220970 - DNA, 25 bp, E. coli
ggtaacggctggacgaacaagaacg

SEQ ID NO: 220971 - DNA, 25 bp, E. coli
ggatacgacgaaaaaagcctgcgcg

SEQ ID NO: 220972 - DNA, 25 bp, E. coli
ggtaacggctggtcgaacaagaacg

SEQ ID NO: 220973 - DNA, 25 bp, E. coli
aaggccagccagaaacacaactgac

SEQ ID NO: 220974 - DNA, 25 bp, E. coli
catacacttgatgaactactttctg

SEQ ID NO: 220975 - DNA, 25 bp, E. coli
aaggccagccagtaacacaactgac

SEQ ID NO: 220976 - DNA, 25 bp, E. coli
catacacttgatcaactactttctg

SEQ ID NO: 220977 - DNA, 25 bp, E. coli
cacttgatcaactactttctgtcag

SEQ ID NO: 220978 - DNA, 25 bp, E. coli
cacttgatcaacaactttctgtcag

SEQ ID NO: 220979 - DNA, 25 bp, E. coli
taaaggccagcctgtaacacaactg

SEQ ID NO: 220980 - DNA, 25 bp, E. coli
tacacttgatcatctactttctgtc

SEQ ID NO: 220981 - DNA, 25 bp, E. coli
tacacttgatcaactactttctgtc

SEQ ID NO: 220982 - DNA, 25 bp, E. coli
taaaggccagccagtaacacaactg

SEQ ID NO: 220983 - DNA, 25 bp, E. coli
aggccagccagttacacaactgact

SEQ ID NO: 220984 - DNA, 25 bp, E. coli
aggccagccagtaacacaactgact

SEQ ID NO: 220985 - DNA, 25 bp, E. coli
aaaggccagccagtaacacaactga

SEQ ID NO: 220986 - DNA, 25 bp, E. coli
aaaggccagccactaacacaactga

SEQ ID NO: 220987 - DNA, 25 bp, E. coli
ttgatcaactactttctgtcagaac

SEQ ID NO: 220988 - DNA, 25 bp, E. coli
ttgatcaactacattctgtcagaac

SEQ ID NO: 220989 - DNA, 25 bp, E. coli
gccgcatacactagatcaactactt

SEQ ID NO: 220990 - DNA, 25 bp, E. coli
gccgcatacacttgatcaactactt

SEQ ID NO: 220991 - DNA, 25 bp, E. coli
gactggccttttaattactgcttta

SEQ ID NO: 220992 - DNA, 25 bp, E. coli
gactggcctttttattactgcttta

SEQ ID NO: 220993 - DNA, 25 bp, E. coli
tggcctttttattactgctttaacg

SEQ ID NO: 220994 - DNA, 25 bp, E. coli
tggcctttttataactgctttaacg

SEQ ID NO: 220995 - DNA, 25 bp, E. coli
aattgacggcttgggcattgacgac

SEQ ID NO: 220996 - DNA, 25 bp, E. coli
aattgacggcttcggcattgacgac

SEQ ID NO: 220997 - DNA, 25 bp, E. coli
caaaaaccggctacttgtcgcagga

SEQ ID NO: 220998 - DNA, 25 bp, E. coli
caaaaaccggcttcttgtcgcagga

SEQ ID NO: 220999 - DNA, 25 bp, E. coli
catatcttagataccgtggcagcgc

SEQ ID NO: 221000 - DNA, 25 bp, E. coli
catatcttagattccgtggcagcgc

SEQ ID NO: 221001 - DNA, 25 bp, E. coli
taacagcagcggatttgtgcccggc

SEQ ID NO: 221002 - DNA, 25 bp, E. coli
taacagcagcggttttgtgcccggc

SEQ ID NO: 221003 - DNA, 25 bp, E. coli
tatcggccatttggatacggcagcg

SEQ ID NO: 221004 - DNA, 25 bp, E. coli
tatcggccatttcgatacggcagcg

SEQ ID NO: 221005 - DNA, 25 bp, E. coli
ttgagaatgtacgactgaacccgcc

SEQ ID NO: 221006 - DNA, 25 bp, E. coli
ttgagaatgtaccactgaacccgcc

SEQ ID NO: 221007 - DNA, 25 bp, E. coli
tgtcctgttggaaaccgcgtgggca

SEQ ID NO: 221008 - DNA, 25 bp, E. coli
tgtcctgttggataccgcgtgggca

SEQ ID NO: 221009 - DNA, 25 bp, E. coli
gcagaagtctcgttagcccaaggcg

SEQ ID NO: 221010 - DNA, 25 bp, E. coli
gcagaagtctcgatagcccaaggcg

SEQ ID NO: 221011 - DNA, 25 bp, E. coli
cattgctcaggctcagcggttggca

SEQ ID NO: 221012 - DNA, 25 bp, E. coli
cattgctcaggcacagcggttggca

SEQ ID NO: 221013 - DNA, 25 bp, E. coli
tcagctctatcaggtttggccggcc

SEQ ID NO: 221014 - DNA, 25 bp, E. coli
tcagctctatcacgtttggccggcc

SEQ ID NO: 221015 - DNA, 25 bp, E. coli
gagaagatcagttataccgcgccga

SEQ ID NO: 221016 - DNA, 25 bp, E. coli
gagaagatcagtaataccgcgccga

SEQ ID NO: 221017 - DNA, 25 bp, E. coli
catgaacaactgctggcgaagctcc

SEQ ID NO: 221018 - DNA, 25 bp, E. coli
catgaacaactggtggcgaagctcc

SEQ ID NO: 221019 - DNA, 25 bp, E. coli
taaaatcaccgatgcggatggccgc

SEQ ID NO: 221020 - DNA, 25 bp, E. coli
taaaatcaccgaagcggatggccgc

SEQ ID NO: 221021 - DNA, 25 bp, E. coli
taaagattatgacttcccggtgccg

SEQ ID NO: 221022 - DNA, 25 bp, E. coli
taaagattatgagttcccggtgccg

SEQ ID NO: 221023 - DNA, 25 bp, E. coli
taaatatttggacaggcccgcacag

SEQ ID NO: 221024 - DNA, 25 bp, E. coli
taaatatttggagaggcccgcacag

SEQ ID NO: 221025 - DNA, 25 bp, E. coli
tattatcaggaacatgccgtccgcg

SEQ ID NO: 221026 - DNA, 25 bp, E. coli
tattatcaggaagatgccgtccgcg

SEQ ID NO: 221027 - DNA, 25 bp, E. coli
tgattggtcataatcgccgcgctgc

SEQ ID NO: 221028 - DNA, 25 bp, E. coli
tgattggtcatattcgccgcgctgc

SEQ ID NO: 221029 - DNA, 25 bp, E. coli
tgtacgaacagaagaaaggccgcgc

SEQ ID NO: 221030 - DNA, 25 bp, E. coli
tgtacgaacagatgaaaggccgcgc

SEQ ID NO: 221031 - DNA, 25 bp, E. coli
gattatatctggcacgagctggcct

SEQ ID NO: 221032 - DNA, 25 bp, E. coli
gataatctcgataccctgctgggca

SEQ ID NO: 221033 - DNA, 25 bp, E. coli
gattatatctgggacgagctggcct

SEQ ID NO: 221034 - DNA, 25 bp, E. coli
gataatctcgattccctgctgggca

SEQ ID NO: 221035 - DNA, 25 bp, E. coli
ggtttgaccgccagcactttgagga

SEQ ID NO: 221036 - DNA, 25 bp, E. coli
ggtttgaccgcctgcactttgagga

SEQ ID NO: 221037 - DNA, 25 bp, E. coli
gagcggctgccctatatcgtggtaa

SEQ ID NO: 221038 - DNA, 25 bp, E. coli
gagcggctgcccaatatcgtggtaa

SEQ ID NO: 221039 - DNA, 25 bp, E. coli
caacaggttgcgtatcatggcctaa

SEQ ID NO: 221040 - DNA, 25 bp, E. coli
caacaggttgcgaatcatggcctaa

SEQ ID NO: 221041 - DNA, 25 bp, E. coli
tacacacccagcagcatatgagcgt

SEQ ID NO: 221042 - DNA, 25 bp, E. coli
taaaaaatgtcccaagccagaagca

SEQ ID NO: 221043 - DNA, 25 bp, E. coli
tacacacccagctgcatatgagcgt

SEQ ID NO: 221044 - DNA, 25 bp, E. coli
taaaaaatgtccgaagccagaagca

SEQ ID NO: 221045 - DNA, 25 bp, E. coli
tatttacaaggatgcgaagactcac

SEQ ID NO: 221046 - DNA, 25 bp, E. coli
tatttacaaggaagcgaagactcac

SEQ ID NO: 221047 - DNA, 25 bp, E. coli
tgcaccagagaacgagcaagatctt

SEQ ID NO: 221048 - DNA, 25 bp, E. coli
tgcaccagagaaggagcaagatctt

SEQ ID NO: 221049 - DNA, 25 bp, E. coli
tccactcaagagcagcgtgaagcag

SEQ ID NO: 221050 - DNA, 25 bp, E. coli
tccactcaagaggagcgtgaagcag

SEQ ID NO: 221051 - DNA, 25 bp, E. coli
gaatatttcatgctaccctgtcgga

SEQ ID NO: 221052 - DNA, 25 bp, E. coli
gaagactcacaagttgctagcgaga

SEQ ID NO: 221053 - DNA, 25 bp, E. coli
gaagactcacaacttgctagcgaga

SEQ ID NO: 221054 - DNA, 25 bp, E. coli
gaatatttcatggtaccctgtcgga

SEQ ID NO: 221055 - DNA, 25 bp, E. coli
gaaacgtgcacttggcattgctacg

SEQ ID NO: 221056 - DNA, 25 bp, E. coli
gaaacgtgcactaggcattgctacg

SEQ ID NO: 221057 - DNA, 25 bp, E. coli
cgctcctgaatttaagaaacgtgca

SEQ ID NO: 221058 - DNA, 25 bp, E. coli
cgctcctgaattaaagaaacgtgca

SEQ ID NO: 221059 - DNA, 25 bp, E. coli
ggcaacctgtatgaatccgctcctg

SEQ ID NO: 221060 - DNA, 25 bp, E. coli
ggcaacctgtatcaatccgctcctg

SEQ ID NO: 221061 - DNA, 25 bp, E. coli
tacggcatggtgctgttgctgcaaa

SEQ ID NO: 221062 - DNA, 25 bp, E. coli
tacggcatggtggtgttgctgcaaa

SEQ ID NO: 221063 - DNA, 25 bp, E. coli
atttatgcccttcgcgggaaccgcg

SEQ ID NO: 221064 - DNA, 25 bp, E. coli
atttatgcccttggcgggaaccgcg

SEQ ID NO: 221065 - DNA, 25 bp, E. coli
aaattggtggcaacttcgctgtcgc

SEQ ID NO: 221066 - DNA, 25 bp, E. coli
aaattggtggcatcttcgctgtcgc

SEQ ID NO: 221067 - DNA, 25 bp, E. coli
tatgagctgacagtactggctgcgg

SEQ ID NO: 221068 - DNA, 25 bp, E. coli
tatgagctgacactactggctgcgg

SEQ ID NO: 221069 - DNA, 25 bp, E. coli
tgaatttcaccactgtagggcgcaa

SEQ ID NO: 221070 - DNA, 25 bp, E. coli
tgaatttcaccagtgtagggcgcaa

SEQ ID NO: 221071 - DNA, 25 bp, E. coli
gactatggccttcgtctgccgctga

SEQ ID NO: 221072 - DNA, 25 bp, E. coli
gactatggccttggtctgccgctga

SEQ ID NO: 221073 - DNA, 25 bp, E. coli
gactttccgccgtggtttgagcagg

SEQ ID NO: 221074 - DNA, 25 bp, E. coli
gactttccgccgaggtttgagcagg

SEQ ID NO: 221075 - DNA, 25 bp, E. coli
cgggcgcggcaccttaactggtact

SEQ ID NO: 221076 - DNA, 25 bp, E. coli
cgggcgcggcacgttaactggtact

SEQ ID NO: 221077 - DNA, 25 bp, E. coli
gggagtctcgtcttactggcaaaca

SEQ ID NO: 221078 - DNA, 25 bp, E. coli
gtggagtcagcaacagaaccggagc

SEQ ID NO: 221079 - DNA, 25 bp, E. coli
gtggagtcagcatcagaaccggagc

SEQ ID NO: 221080 - DNA, 25 bp, E. coli
gggagtctcgtcatactggcaaaca

SEQ ID NO: 221081 - DNA, 25 bp, E. coli
ttactggttaatggcctacgggtgc

SEQ ID NO: 221082 - DNA, 25 bp, E. coli
ttactggttaatcgcctacgggtgc

SEQ ID NO: 221083 - DNA, 25 bp, E. coli
tacgctaaataatcactgtgttgag

SEQ ID NO: 221084 - DNA, 25 bp, E. coli
taaaagcggcttgctgacaggaggc

SEQ ID NO: 221085 - DNA, 25 bp, E. coli
taaaagcggcttcctgacaggaggc

SEQ ID NO: 221086 - DNA, 25 bp, E. coli
agggtattgcccaataaatcgtgca

SEQ ID NO: 221087 - DNA, 25 bp, E. coli
agggtattgccctataaatcgtgca

SEQ ID NO: 221088 - DNA, 25 bp, E. coli
acaggaggccgtattgttttgcagc

SEQ ID NO: 221089 - DNA, 25 bp, E. coli
acaggaggccgttttgttttgcagc

SEQ ID NO: 221090 - DNA, 25 bp, E. coli
tagtacccgatataagcggcttcct

SEQ ID NO: 221091 - DNA, 25 bp, E. coli
tacgctaaataaacactgtgttgag

SEQ ID NO: 221092 - DNA, 25 bp, E. coli
tagtacccgataaaagcggcttcct

SEQ ID NO: 221093 - DNA, 25 bp, E. coli
tgcacaattttaccgcaccagattg

SEQ ID NO: 221094 - DNA, 25 bp, E. coli
tgcatccatctggtatctccagctg

SEQ ID NO: 221095 - DNA, 25 bp, E. coli
tgcacaattttagcgcaccagattg

SEQ ID NO: 221096 - DNA, 25 bp, E. coli
tgcatccatctgctatctccagctg

SEQ ID NO: 221097 - DNA, 25 bp, E. coli
ttttgttttgcagcccacctcaacg

SEQ ID NO: 221098 - DNA, 25 bp, E. coli
ttttgttttgcaccccacctcaacg

SEQ ID NO: 221099 - DNA, 25 bp, E. coli
ccatcgctgatgctgcagaacttta

SEQ ID NO: 221100 - DNA, 25 bp, E. coli
ccagaatggtgcttcttcagggtat

SEQ ID NO: 221101 - DNA, 25 bp, E. coli
ccagaatggtgcatcttcagggtat

SEQ ID NO: 221102 - DNA, 25 bp, E. coli
ccatcgctgatggtgcagaacttta

SEQ ID NO: 221103 - DNA, 25 bp, E. coli
gattggtgccccagaatggtgcatc

SEQ ID NO: 221104 - DNA, 25 bp, E. coli
gattggtgcccctgaatggtgcatc

SEQ ID NO: 221105 - DNA, 25 bp, E. coli
cacaatggatgtcagcaggaagtca

SEQ ID NO: 221106 - DNA, 25 bp, E. coli
cacaatggatgtgagcaggaagtca

SEQ ID NO: 221107 - DNA, 25 bp, E. coli
tataaaatgtcaccggtgttcaccc

SEQ ID NO: 221108 - DNA, 25 bp, E. coli
tatcgctatgactggaaagctttcc

SEQ ID NO: 221109 - DNA, 25 bp, E. coli
tataaaatgtcagcggtgttcaccc

SEQ ID NO: 221110 - DNA, 25 bp, E. coli
tatcgctatgacaggaaagctttcc

SEQ ID NO: 221111 - DNA, 25 bp, E. coli
tgaaaatttcgtatcaggcaacgcc

SEQ ID NO: 221112 - DNA, 25 bp, E. coli
tgacaaatgggcactaatcccaggg

SEQ ID NO: 221113 - DNA, 25 bp, E. coli
tgacaaatgggctctaatcccaggg

SEQ ID NO: 221114 - DNA, 25 bp, E. coli
tgaaaatttcgtttcaggcaacgcc

SEQ ID NO: 221115 - DNA, 25 bp, E. coli
tcatggttgtttgcatggcagacca

SEQ ID NO: 221116 - DNA, 25 bp, E. coli
tcatggttgtttccatggcagacca

SEQ ID NO: 221117 - DNA, 25 bp, E. coli
gcaacagggcgcctaatgatcagca

SEQ ID NO: 221118 - DNA, 25 bp, E. coli
gcaacagggcgcgtaatgatcagca

SEQ ID NO: 221119 - DNA, 25 bp, E. coli
cgacagacggatttagatggcaaca

SEQ ID NO: 221120 - DNA, 25 bp, E. coli
cgacagacggatatagatggcaaca

SEQ ID NO: 221121 - DNA, 25 bp, E. coli
tggcagaccacggtatatacgaagg

SEQ ID NO: 221122 - DNA, 25 bp, E. coli
tggcagaccacgctatatacgaagg

SEQ ID NO: 221123 - DNA, 25 bp, E. coli
taatctggcctttcgctatcgctat

SEQ ID NO: 221124 - DNA, 25 bp, E. coli
taatcccagggaatcagacacaatg

SEQ ID NO: 221125 - DNA, 25 bp, E. coli
taatctggccttacgctatcgctat

SEQ ID NO: 221126 - DNA, 25 bp, E. coli
taatcccagggattcagacacaatg

SEQ ID NO: 221127 - DNA, 25 bp, E. coli
aagtgacctgttttgtcggccacga

SEQ ID NO: 221128 - DNA, 25 bp, E. coli
aagtgacctgttatgtcggccacga

SEQ ID NO: 221129 - DNA, 25 bp, E. coli
taaagtgacctgttttgtcggccac

SEQ ID NO: 221130 - DNA, 25 bp, E. coli
taaagtgacctgatttgtcggccac

SEQ ID NO: 221131 - DNA, 25 bp, E. coli
agtgacctgttttgtcggccacgat

SEQ ID NO: 221132 - DNA, 25 bp, E. coli
agtgacctgtttagtcggccacgat

SEQ ID NO: 221133 - DNA, 25 bp, E. coli
aaagtgacctgttttgtcggccacg

SEQ ID NO: 221134 - DNA, 25 bp, E. coli
aaagtgacctgtattgtcggccacg

SEQ ID NO: 221135 - DNA, 25 bp, E. coli
ttgtcggccacgatatccgcagtct

SEQ ID NO: 221136 - DNA, 25 bp, E. coli
ttgtcggccacgttatccgcagtct

SEQ ID NO: 221137 - DNA, 25 bp, E. coli
tgtcggccacgaaatccgcagtctg

SEQ ID NO: 221138 - DNA, 25 bp, E. coli
tgtcggccacgatatccgcagtctg

SEQ ID NO: 221139 - DNA, 25 bp, E. coli
tcggccacgatatccgcagtctggc

SEQ ID NO: 221140 - DNA, 25 bp, E. coli
tcggccacgataaccgcagtctggc

SEQ ID NO: 221141 - DNA, 25 bp, E. coli
gaatttttatcgcgcgcaacggcaa

SEQ ID NO: 221142 - DNA, 25 bp, E. coli
gaatttttatcgggcgcaacggcaa

SEQ ID NO: 221143 - DNA, 25 bp, E. coli
cggccacgatatccgcagtctggcg

SEQ ID NO: 221144 - DNA, 25 bp, E. coli
cggccacgatatgcgcagtctggcg

SEQ ID NO: 221145 - DNA, 25 bp, E. coli
gtcggccacgatatccgcagtctgg

SEQ ID NO: 221146 - DNA, 25 bp, E. coli
ggcgaatttttaacgggcgcaacgg

SEQ ID NO: 221147 - DNA, 25 bp, E. coli
gtcggccacgatttccgcagtctgg

SEQ ID NO: 221148 - DNA, 25 bp, E. coli
ggcgaatttttatcgggcgcaacgg

SEQ ID NO: 221149 - DNA, 25 bp, E. coli
tgaaacgccgtatactcggtgtgcg

SEQ ID NO: 221150 - DNA, 25 bp, E. coli
tgaaacgccgtaaactcggtgtgcg

SEQ ID NO: 221151 - DNA, 25 bp, E. coli
tcgcggtgggcacgtgacttatcac

SEQ ID NO: 221152 - DNA, 25 bp, E. coli
tcgacgcggttgttcattccacggt

SEQ ID NO: 221153 - DNA, 25 bp, E. coli
tcgacgcggttgatcattccacggt

SEQ ID NO: 221154 - DNA, 25 bp, E. coli
tcgcggtgggcaggtgacttatcac

SEQ ID NO: 221155 - DNA, 25 bp, E. coli
gaactggtgaccatgcttgagcaaa

SEQ ID NO: 221156 - DNA, 25 bp, E. coli
gaactggtgaccttgcttgagcaaa

SEQ ID NO: 221157 - DNA, 25 bp, E. coli
cccttgatgaaaactggctggtcga

SEQ ID NO: 221158 - DNA, 25 bp, E. coli
cccttgatgaaatctggctggtcga

SEQ ID NO: 221159 - DNA, 25 bp, E. coli
cttgagcaaacactggtgaataccc

SEQ ID NO: 221160 - DNA, 25 bp, E. coli
cttgagcaaacagtggtgaataccc

SEQ ID NO: 221161 - DNA, 25 bp, E. coli
gtatagaagcgcatcctcgggctga

SEQ ID NO: 221162 - DNA, 25 bp, E. coli
gatacccgcgatgatagtacccttg

SEQ ID NO: 221163 - DNA, 25 bp, E. coli
gtatagaagcgcttcctcgggctga

SEQ ID NO: 221164 - DNA, 25 bp, E. coli
gatacccgcgatcatagtacccttg

SEQ ID NO: 221165 - DNA, 25 bp, E. coli
ggctggtcgagcactatccggtatt

SEQ ID NO: 221166 - DNA, 25 bp, E. coli
ggctggtcgagctctatccggtatt

SEQ ID NO: 221167 - DNA, 25 bp, E. coli
tcacaatggaaacccgaagcgacga

SEQ ID NO: 221168 - DNA, 25 bp, E. coli
tcactgggtttacgtattcgacgcg

SEQ ID NO: 221169 - DNA, 25 bp, E. coli
tcacaatggaaagccgaagcgacga

SEQ ID NO: 221170 - DNA, 25 bp, E. coli
tcactgggtttaggtattcgacgcg

SEQ ID NO: 221171 - DNA, 25 bp, E. coli
caggcaatgccatacccggtgataa

SEQ ID NO: 221172 - DNA, 25 bp, E. coli
caggcaatgccaaacccggtgataa

SEQ ID NO: 221173 - DNA, 25 bp, E. coli
tacaacggtgtcgattacgatgcca

SEQ ID NO: 221174 - DNA, 25 bp, E. coli
tacaacggtgtccattacgatgcca

SEQ ID NO: 221175 - DNA, 25 bp, E. coli
taccaacggcaagtttgaaagcgag

SEQ ID NO: 221176 - DNA, 25 bp, E. coli
tacccctgagcacatcatcgcgatg

SEQ ID NO: 221177 - DNA, 25 bp, E. coli
taccaacggcaactttgaaagcgag

SEQ ID NO: 221178 - DNA, 25 bp, E. coli
tacccctgagcagatcatcgcgatg

SEQ ID NO: 221179 - DNA, 25 bp, E. coli
tattactggtctggaaaacattcgc

SEQ ID NO: 221180 - DNA, 25 bp, E. coli
tattttggtacaactggtggcgcag

SEQ ID NO: 221181 - DNA, 25 bp, E. coli
tattttggtacatctggtggcgcag

SEQ ID NO: 221182 - DNA, 25 bp, E. coli
tattactggtctcgaaaacattcgc

SEQ ID NO: 221183 - DNA, 25 bp, E. coli
gccagtctgggataaagtcgcatcg

SEQ ID NO: 221184 - DNA, 25 bp, E. coli
gccagtctgggaaaaagtcgcatcg

SEQ ID NO: 221185 - DNA, 25 bp, E. coli
gaacaaaatttgctcgggcgatccc

SEQ ID NO: 221186 - DNA, 25 bp, E. coli
gaacaaaatttggtcgggcgatccc

SEQ ID NO: 221187 - DNA, 25 bp, E. coli
tcaaaatacgagaaatgccgccgca

SEQ ID NO: 221188 - DNA, 25 bp, E. coli
tcaaaatacgagtaatgccgccgca

SEQ ID NO: 221189 - DNA, 25 bp, E. coli
tcaactcggcgtgacatacaacggt

SEQ ID NO: 221190 - DNA, 25 bp, E. coli
tcaactcggcgtcacatacaacggt

SEQ ID NO: 221191 - DNA, 25 bp, E. coli
gaggctggccccttcgatacagtgg

SEQ ID NO: 221192 - DNA, 25 bp, E. coli
gaggctggccccatcgatacagtgg

SEQ ID NO: 221193 - DNA, 25 bp, E. coli
tattaccccggatgcccgtgaagtg

SEQ ID NO: 221194 - DNA, 25 bp, E. coli
tattaccccggaagcccgtgaagtg

SEQ ID NO: 221195 - DNA, 25 bp, E. coli
tgggttttaccatcaccgaatgtga

SEQ ID NO: 221196 - DNA, 25 bp, E. coli
tgggttttaccaacaccgaatgtga

SEQ ID NO: 221197 - DNA, 25 bp, E. coli
tgatgaaggaaaaacagtcgctgga

SEQ ID NO: 221198 - DNA, 25 bp, E. coli
tgatgaaggaaatacagtcgctgga

SEQ ID NO: 221199 - DNA, 25 bp, E. coli
gaatttggtacgacatccagcgtga

SEQ ID NO: 221200 - DNA, 25 bp, E. coli
gaatttggtacgtcatccagcgtga

SEQ ID NO: 221201 - DNA, 25 bp, E. coli
gaaattcctgtaagtcgcctggccg

SEQ ID NO: 221202 - DNA, 25 bp, E. coli
gacgaaatcgacatggtgctggaag

SEQ ID NO: 221203 - DNA, 25 bp, E. coli
gaaattcctgtatgtcgcctggccg

SEQ ID NO: 221204 - DNA, 25 bp, E. coli
gatattcgtgaaccacacgcgcgcg

SEQ ID NO: 221205 - DNA, 25 bp, E. coli
gatattcgtgaagcacacgcgcgcg

SEQ ID NO: 221206 - DNA, 25 bp, E. coli
ggccggctaactggcaatccctatg

SEQ ID NO: 221207 - DNA, 25 bp, E. coli
tggaccctgaacaacgacgaaatcg

SEQ ID NO: 221208 - DNA, 25 bp, E. coli
ggccggctaactcgcaatccctatg

SEQ ID NO: 221209 - DNA, 25 bp, E. coli
ggcaatgtccgtggttctgcgcgcc

SEQ ID NO: 221210 - DNA, 25 bp, E. coli
ggcaatgtccgtcgttctgcgcgcc

SEQ ID NO: 221211 - DNA, 25 bp, E. coli
tggaccctgaactacgacgaaatcg

SEQ ID NO: 221212 - DNA, 25 bp, E. coli
gatgtttatcccgaaaggctccagc

SEQ ID NO: 221213 - DNA, 25 bp, E. coli
gacgaaatcgacttggtgctggaag

SEQ ID NO: 221214 - DNA, 25 bp, E. coli
gatgtttatccccaaaggctccagc

SEQ ID NO: 221215 - DNA, 25 bp, E. coli
cagaacggcctggttaacgcagcag

SEQ ID NO: 221216 - DNA, 25 bp, E. coli
cagaacggcctgcttaacgcagcag

SEQ ID NO: 221217 - DNA, 25 bp, E. coli
taaagaacatgaccgaagccgagcg

SEQ ID NO: 221218 - DNA, 25 bp, E. coli
taaagaacatgagcgaagccgagcg

SEQ ID NO: 221219 - DNA, 25 bp, E. coli
tatgaacagaaaatccagaacgcct

SEQ ID NO: 221220 - DNA, 25 bp, E. coli
tatgaacagaaattccagaacgcct

SEQ ID NO: 221221 - DNA, 25 bp, E. coli
ttttgtgtggcccttgcgctaaccg

SEQ ID NO: 221222 - DNA, 25 bp, E. coli
ttttgtgtggccgttgcgctaaccg

SEQ ID NO: 221223 - DNA, 25 bp, E. coli
ttttaatgccggacgcaaccaggcc

SEQ ID NO: 221224 - DNA, 25 bp, E. coli
ttttaatgccggtcgcaaccaggcc

SEQ ID NO: 221225 - DNA, 25 bp, E. coli
tgcaaatagccgaagaaacgctgcg

SEQ ID NO: 221226 - DNA, 25 bp, E. coli
tgcaaagcgttaaattaccggcggg

SEQ ID NO: 221227 - DNA, 25 bp, E. coli
tgcaaatagccgtagaaacgctgcg

SEQ ID NO: 221228 - DNA, 25 bp, E. coli
tgcaaagcgttatattaccggcggg

SEQ ID NO: 221229 - DNA, 25 bp, E. coli
cctttaaagaagtggcagatgcgct

SEQ ID NO: 221230 - DNA, 25 bp, E. coli
cctttaaagaagaggcagatgcgct

SEQ ID NO: 221231 - DNA, 25 bp, E. coli
gctggtttctaatgtcgcgcaaagc

SEQ ID NO: 221232 - DNA, 25 bp, E. coli
gctggtttctaaagtcgcgcaaagc

SEQ ID NO: 221233 - DNA, 25 bp, E. coli
gcaaattactttgcaacgggcgcgg

SEQ ID NO: 221234 - DNA, 25 bp, E. coli
gcaaattactttccaacgggcgcgg

SEQ ID NO: 221235 - DNA, 25 bp, E. coli
gatgcgctggcaatacgtcaaagcc

SEQ ID NO: 221236 - DNA, 25 bp, E. coli
gatgcgctggcattacgtcaaagcc

SEQ ID NO: 221237 - DNA, 25 bp, E. coli
caagaaaggttagcgcggatgacgc

SEQ ID NO: 221238 - DNA, 25 bp, E. coli
aattggccaagctttgcggctgggc

SEQ ID NO: 221239 - DNA, 25 bp, E. coli
caagaaaggttaccgcggatgacgc

SEQ ID NO: 221240 - DNA, 25 bp, E. coli
aattggccaagcattgcggctgggc

SEQ ID NO: 221241 - DNA, 25 bp, E. coli
tagaaccctggattgcgaccatagc

SEQ ID NO: 221242 - DNA, 25 bp, E. coli
tagaaccctggaatgcgaccatagc

SEQ ID NO: 221243 - DNA, 25 bp, E. coli
tattttcttcagagcaggccgggcc

SEQ ID NO: 221244 - DNA, 25 bp, E. coli
tattttcttcagtgcaggccgggcc

SEQ ID NO: 221245 - DNA, 25 bp, E. coli
ttaaacccggcatatagaaccctgg

SEQ ID NO: 221246 - DNA, 25 bp, E. coli
ttaaacccggcaaatagaaccctgg

SEQ ID NO: 221247 - DNA, 25 bp, E. coli
tcataggcaaggtagttaaggcgca

SEQ ID NO: 221248 - DNA, 25 bp, E. coli
tcataggcaaggaagttaaggcgca

SEQ ID NO: 221249 - DNA, 25 bp, E. coli
ccaagttttccgcaaggcatgctga

SEQ ID NO: 221250 - DNA, 25 bp, E. coli
ccaagttttccggaaggcatgctga

SEQ ID NO: 221251 - DNA, 25 bp, E. coli
cgtggcttctgctaatggtgattca

SEQ ID NO: 221252 - DNA, 25 bp, E. coli
cgtggcttctgcaaatggtgattca

SEQ ID NO: 221253 - DNA, 25 bp, E. coli
gatactcgttgatccggctgagccg

SEQ ID NO: 221254 - DNA, 25 bp, E. coli
gatactcgttgaaccggctgagccg

SEQ ID NO: 221255 - DNA, 25 bp, E. coli
taatgtttggcgaggattcagacgc

SEQ ID NO: 221256 - DNA, 25 bp, E. coli
taatgtttggcgtggattcagacgc

SEQ ID NO: 221257 - DNA, 25 bp, E. coli
gatgcaaaggcaagggtcccaacga

SEQ ID NO: 221258 - DNA, 25 bp, E. coli
gatgcaaaggcatgggtcccaacga

SEQ ID NO: 221259 - DNA, 25 bp, E. coli
cagtgtttatattaggattcggtcc

SEQ ID NO: 221260 - DNA, 25 bp, E. coli
catgagagttacctcagtgtttata

SEQ ID NO: 221261 - DNA, 25 bp, E. coli
cagtgtttatataaggattcggtcc

SEQ ID NO: 221262 - DNA, 25 bp, E. coli
catgagagttacgtcagtgtttata

SEQ ID NO: 221263 - DNA, 25 bp, E. coli
taaatatcagcataaagcccgcatc

SEQ ID NO: 221264 - DNA, 25 bp, E. coli
taaatatcagcaaaaagcccgcatc

SEQ ID NO: 221265 - DNA, 25 bp, E. coli
aaaagcccgcatcatgaatactgga

SEQ ID NO: 221266 - DNA, 25 bp, E. coli
aaaagcccgcatgatgaatactgga

SEQ ID NO: 221267 - DNA, 25 bp, E. coli
tatccagagaataaaatctgtcgca

SEQ ID NO: 221268 - DNA, 25 bp, E. coli
tatccagagaattaaatctgtcgca

SEQ ID NO: 221269 - DNA, 25 bp, E. coli
tctgatcggttcctgcgttagttca

SEQ ID NO: 221270 - DNA, 25 bp, E. coli
tctgtcgcagataaggttgtattaa

SEQ ID NO: 221271 - DNA, 25 bp, E. coli
tctgtcgcagattaggttgtattaa

SEQ ID NO: 221272 - DNA, 25 bp, E. coli
tctgatcggttcgtgcgttagttca

SEQ ID NO: 221273 - DNA, 25 bp, E. coli
gaatactggatatgaagcatgagag

SEQ ID NO: 221274 - DNA, 25 bp, E. coli
gaatgttcgggtaaaatatcagcaa

SEQ ID NO: 221275 - DNA, 25 bp, E. coli
gaatactggataagaagcatgagag

SEQ ID NO: 221276 - DNA, 25 bp, E. coli
gaatgttcgggttaaatatcagcaa

SEQ ID NO: 221277 - DNA, 25 bp, E. coli
gttcctgcgttacttcacatcacga

SEQ ID NO: 221278 - DNA, 25 bp, E. coli
gttcctgcgttagttcacatcacga

SEQ ID NO: 221279 - DNA, 25 bp, E. coli
taatagtctgtatcaggaatgttcg

SEQ ID NO: 221280 - DNA, 25 bp, E. coli
taatagtctgtaacaggaatgttcg

SEQ ID NO: 221281 - DNA, 25 bp, E. coli
aattgataataattcggctgaatcc

SEQ ID NO: 221282 - DNA, 25 bp, E. coli
aattgataataaatcggctgaatcc

SEQ ID NO: 221283 - DNA, 25 bp, E. coli
caacttacagcaatttctctatttt

SEQ ID NO: 221284 - DNA, 25 bp, E. coli
caacttacagcattttctctatttt

SEQ ID NO: 221285 - DNA, 25 bp, E. coli
cattcagaataatattctacattca

SEQ ID NO: 221286 - DNA, 25 bp, E. coli
cattcagaataaaattctacattca

SEQ ID NO: 221287 - DNA, 25 bp, E. coli
tacattcaataataaatgcagaata

SEQ ID NO: 221288 - DNA, 25 bp, E. coli
tacattcaataaaaaatgcagaata

SEQ ID NO: 221289 - DNA, 25 bp, E. coli
attctacattcattaaaaaatgcag

SEQ ID NO: 221290 - DNA, 25 bp, E. coli
attctacattcaataaaaaatgcag

SEQ ID NO: 221291 - DNA, 25 bp, E. coli
aaattgataatatatcggctgaatc

SEQ ID NO: 221292 - DNA, 25 bp, E. coli
aaattgataataaatcggctgaatc

SEQ ID NO: 221293 - DNA, 25 bp, E. coli
acattcaataaaaaatgcagaataa

SEQ ID NO: 221294 - DNA, 25 bp, E. coli
acattcaataaataatgcagaataa

SEQ ID NO: 221295 - DNA, 25 bp, E. coli
tacagcaatttctctatttttttaa

SEQ ID NO: 221296 - DNA, 25 bp, E. coli
tttaattaatcctaaaatagagagc

SEQ ID NO: 221297 - DNA, 25 bp, E. coli
tttaattaatccaaaaatagagagc

SEQ ID NO: 221298 - DNA, 25 bp, E. coli
tacagcaatttcactatttttttaa

SEQ ID NO: 221299 - DNA, 25 bp, E. coli
tctacattcaataaaaaatgcagaa

SEQ ID NO: 221300 - DNA, 25 bp, E. coli
tctacattcaattaaaaatgcagaa

SEQ ID NO: 221301 - DNA, 25 bp, E. coli
ctacattcaataaaaaatgcagaat

SEQ ID NO: 221302 - DNA, 25 bp, E. coli
ctacattcaatataaaatgcagaat

SEQ ID NO: 221303 - DNA, 25 bp, E. coli
aacgccgggcgctgatatgacgccc

SEQ ID NO: 221304 - DNA, 25 bp, E. coli
aacgccgggcgcagatatgacgccc

SEQ ID NO: 221305 - DNA, 25 bp, E. coli
ttcgcgcgcagtagaatgctttacg

SEQ ID NO: 221306 - DNA, 25 bp, E. coli
ttttcgcgcgcacttgaatgcttta

SEQ ID NO: 221307 - DNA, 25 bp, E. coli
ttttcgcgcgcagttgaatgcttta

SEQ ID NO: 221308 - DNA, 25 bp, E. coli
ttggtcacggcgtcaacgccgggcg

SEQ ID NO: 221309 - DNA, 25 bp, E. coli
ttcgcgcgcagttgaatgctttacg

SEQ ID NO: 221310 - DNA, 25 bp, E. coli
ttggtcacggcgacaacgccgggcg

SEQ ID NO: 221311 - DNA, 25 bp, E. coli
tcgcgcgcagttcaatgctttacgc

SEQ ID NO: 221312 - DNA, 25 bp, E. coli
tcgcgcgcagttgaatgctttacgc

SEQ ID NO: 221313 - DNA, 25 bp, E. coli
tctgcccacgcgcacgttggtcacg

SEQ ID NO: 221314 - DNA, 25 bp, E. coli
tctgcccacgcggacgttggtcacg

SEQ ID NO: 221315 - DNA, 25 bp, E. coli
gcagttgaatgcattacgcgcggtg

SEQ ID NO: 221316 - DNA, 25 bp, E. coli
gcagttgaatgctttacgcgcggtg

SEQ ID NO: 221317 - DNA, 25 bp, E. coli
gcacgttggtcagggcgtcaacgcc

SEQ ID NO: 221318 - DNA, 25 bp, E. coli
gcacgttggtcacggcgtcaacgcc

SEQ ID NO: 221319 - DNA, 25 bp, E. coli
cggtgccagtggaagggctttctct

SEQ ID NO: 221320 - DNA, 25 bp, E. coli
ctttacgcgcggtgccagtggaagg

SEQ ID NO: 221321 - DNA, 25 bp, E. coli
cggtgccagtggtagggctttctct

SEQ ID NO: 221322 - DNA, 25 bp, E. coli
ctttacgcgcggagccagtggaagg

SEQ ID NO: 221323 - DNA, 25 bp, E. coli
gggcgcagatatcacgcccggcaaa

SEQ ID NO: 221324 - DNA, 25 bp, E. coli
gggcgcagatatgacgcccggcaaa

SEQ ID NO: 221325 - DNA, 25 bp, E. coli
aagccctggagaccggatccctgag

SEQ ID NO: 221326 - DNA, 25 bp, E. coli
aagccctggagagcggatccctgag

SEQ ID NO: 221327 - DNA, 25 bp, E. coli
agagctttattagcccgtcgcgagg

SEQ ID NO: 221328 - DNA, 25 bp, E. coli
agagctttattaccccgtcgcgagg

SEQ ID NO: 221329 - DNA, 25 bp, E. coli
ttattaccccgtcgcgagggatgct

SEQ ID NO: 221330 - DNA, 25 bp, E. coli
ttattaccccgtggcgagggatgct

SEQ ID NO: 221331 - DNA, 25 bp, E. coli
tgtagtaagcccaggagagcggatc

SEQ ID NO: 221332 - DNA, 25 bp, E. coli
tgtagtaagccctggagagcggatc

SEQ ID NO: 221333 - DNA, 25 bp, E. coli
tcgttttccctgactcattttgcgg

SEQ ID NO: 221334 - DNA, 25 bp, E. coli
tcgttttccctgtctcattttgcgg

SEQ ID NO: 221335 - DNA, 25 bp, E. coli
cctgactcattttgcgggtgtagta

SEQ ID NO: 221336 - DNA, 25 bp, E. coli
cctgactcatttagcgggtgtagta

SEQ ID NO: 221337 - DNA, 25 bp, E. coli
gaacaacgcccgtttgagagcttta

SEQ ID NO: 221338 - DNA, 25 bp, E. coli
gaacaacgcccgattgagagcttta

SEQ ID NO: 221339 - DNA, 25 bp, E. coli
ccgacaggaacatcgcccgtttgag

SEQ ID NO: 221340 - DNA, 25 bp, E. coli
cgcgagggatgcacaccgcgtattg

SEQ ID NO: 221341 - DNA, 25 bp, E. coli
cgcgagggatgctcaccgcgtattg

SEQ ID NO: 221342 - DNA, 25 bp, E. coli
ccgacaggaacaacgcccgtttgag

SEQ ID NO: 221343 - DNA, 25 bp, E. coli
cggcgaaggccgtcaggaacaacgc

SEQ ID NO: 221344 - DNA, 25 bp, E. coli
cggcgaaggccgacaggaacaacgc

SEQ ID NO: 221345 - DNA, 25 bp, E. coli
gtttgagagcttaattaccccgtcg

SEQ ID NO: 221346 - DNA, 25 bp, E. coli
gtttgagagctttattaccccgtcg

SEQ ID NO: 221347 - DNA, 25 bp, E. coli
agtcgccacgtagcggcgaaaccat

SEQ ID NO: 221348 - DNA, 25 bp, E. coli
agtcgccacgtaccggcgaaaccat

SEQ ID NO: 221349 - DNA, 25 bp, E. coli
tatcgagtcgcctcgtaccggcgaa

SEQ ID NO: 221350 - DNA, 25 bp, E. coli
tagccgatcatatgggcgtgtattt

SEQ ID NO: 221351 - DNA, 25 bp, E. coli
tatttgggcgatcggcaatttatcg

SEQ ID NO: 221352 - DNA, 25 bp, E. coli
tagccgatcataagggcgtgtattt

SEQ ID NO: 221353 - DNA, 25 bp, E. coli
tatttgggcgatgggcaatttatcg

SEQ ID NO: 221354 - DNA, 25 bp, E. coli
tatcgagtcgccacgtaccggcgaa

SEQ ID NO: 221355 - DNA, 25 bp, E. coli
tcatatgggcgtctatttgggcgat

SEQ ID NO: 221356 - DNA, 25 bp, E. coli
tcatatgggcgtgtatttgggcgat

SEQ ID NO: 221357 - DNA, 25 bp, E. coli
gaaaccattcggataagccgattag

SEQ ID NO: 221358 - DNA, 25 bp, E. coli
gaaaccattcggttaagccgattag

SEQ ID NO: 221359 - DNA, 25 bp, E. coli
cgatgggcaatttatcgagtcgcca

SEQ ID NO: 221360 - DNA, 25 bp, E. coli
cgagatagccgatcatatgggcgtg

SEQ ID NO: 221361 - DNA, 25 bp, E. coli
cgatgggcaattaatcgagtcgcca

SEQ ID NO: 221362 - DNA, 25 bp, E. coli
cgagatagccgaacatatgggcgtg

SEQ ID NO: 221363 - DNA, 25 bp, E. coli
cggataagccgattagccgaacctt

SEQ ID NO: 221364 - DNA, 25 bp, E. coli
cggataagccgaatagccgaacctt

SEQ ID NO: 221365 - DNA, 25 bp, E. coli
gataagccgatttgccgaacctttc

SEQ ID NO: 221366 - DNA, 25 bp, E. coli
gataagccgattagccgaacctttc

SEQ ID NO: 221367 - DNA, 25 bp, E. coli
gaccattttttgcgcgcgcgcagga

SEQ ID NO: 221368 - DNA, 25 bp, E. coli
gaccattttttgggcgcgcgcagga

SEQ ID NO: 221369 - DNA, 25 bp, E. coli
cataacgttagtcggcagtagtctg

SEQ ID NO: 221370 - DNA, 25 bp, E. coli
cataacgttagtgggcagtagtctg

SEQ ID NO: 221371 - DNA, 25 bp, E. coli
tagatatagagtaccacatcgcggc

SEQ ID NO: 221372 - DNA, 25 bp, E. coli
tagatatagagttccacatcgcggc

SEQ ID NO: 221373 - DNA, 25 bp, E. coli
ttcaataaattcgaacataggcttc

SEQ ID NO: 221374 - DNA, 25 bp, E. coli
ttcaataaattccaacataggcttc

SEQ ID NO: 221375 - DNA, 25 bp, E. coli
tgttctgtcataacgttagtgggca

SEQ ID NO: 221376 - DNA, 25 bp, E. coli
tgttctgtcatatcgttagtgggca

SEQ ID NO: 221377 - DNA, 25 bp, E. coli
tctctgtggcaggattgtgaataaa

SEQ ID NO: 221378 - DNA, 25 bp, E. coli
tctctgtggcagcattgtgaataaa

SEQ ID NO: 221379 - DNA, 25 bp, E. coli
gcagtagtctgcctgattaattttc

SEQ ID NO: 221380 - DNA, 25 bp, E. coli
gcagtagtctgcgtgattaattttc

SEQ ID NO: 221381 - DNA, 25 bp, E. coli
gcggctttctatgcgttgttcaata

SEQ ID NO: 221382 - DNA, 25 bp, E. coli
gcggctttctatccgttgttcaata

SEQ ID NO: 221383 - DNA, 25 bp, E. coli
gaataaagtgtctacaagcaacggg

SEQ ID NO: 221384 - DNA, 25 bp, E. coli
gaataaagtgtcaacaagcaacggg

SEQ ID NO: 221385 - DNA, 25 bp, E. coli
gaacataggcttcgatttattgcgc

SEQ ID NO: 221386 - DNA, 25 bp, E. coli
gaacataggcttggatttattgcgc

SEQ ID NO: 221387 - DNA, 25 bp, E. coli
gatttattgcgcaatctctgtggca

SEQ ID NO: 221388 - DNA, 25 bp, E. coli
gatttattgcgctatctctgtggca

SEQ ID NO: 221389 - DNA, 25 bp, E. coli
gggcatcgcccaatcaaacatctat

SEQ ID NO: 221390 - DNA, 25 bp, E. coli
gggcatcgcccattcaaacatctat

SEQ ID NO: 221391 - DNA, 25 bp, E. coli
caacaaagcccggattcattgggca

SEQ ID NO: 221392 - DNA, 25 bp, E. coli
caacaaagcccgcattcattgggca

SEQ ID NO: 221393 - DNA, 25 bp, E. coli
tccagacacggaaccgggaacgtgg

SEQ ID NO: 221394 - DNA, 25 bp, E. coli
tccagacacggatccgggaacgtgg

SEQ ID NO: 221395 - DNA, 25 bp, E. coli
tcatgccgtttttcgaacatgagta

SEQ ID NO: 221396 - DNA, 25 bp, E. coli
tcatgccgttttacgaacatgagta

SEQ ID NO: 221397 - DNA, 25 bp, E. coli
gcagaactggaattgatggtccgac

SEQ ID NO: 221398 - DNA, 25 bp, E. coli
gcagaactggaaatgatggtccgac

SEQ ID NO: 221399 - DNA, 25 bp, E. coli
gacagcttaagccatgacgaaaaac

SEQ ID NO: 221400 - DNA, 25 bp, E. coli
gacagcttaagcgatgacgaaaaac

SEQ ID NO: 221401 - DNA, 25 bp, E. coli
gtaaaccggccgttgcagaactgga

SEQ ID NO: 221402 - DNA, 25 bp, E. coli
gtaaaccggccgatgcagaactgga

SEQ ID NO: 221403 - DNA, 25 bp, E. coli
ccgccgtggtatgcgcgaactcgat

SEQ ID NO: 221404 - DNA, 25 bp, E. coli
cgaactcgatatttcaatcatgccg

SEQ ID NO: 221405 - DNA, 25 bp, E. coli
ccgccgtggtatccgcgaactcgat

SEQ ID NO: 221406 - DNA, 25 bp, E. coli
cgaactcgatatatcaatcatgccg

SEQ ID NO: 221407 - DNA, 25 bp, E. coli
cattcattgggcatgccgccgtggt

SEQ ID NO: 221408 - DNA, 25 bp, E. coli
cattcattgggcttgccgccgtggt

SEQ ID NO: 221409 - DNA, 25 bp, E. coli
ggctgatgaatctcggtaaaccggc

SEQ ID NO: 221410 - DNA, 25 bp, E. coli
ggctgatgaatcacggtaaaccggc

SEQ ID NO: 221411 - DNA, 25 bp, E. coli
gatggtccgactgatccagacacgg

SEQ ID NO: 221412 - DNA, 25 bp, E. coli
gatggtccgactcatccagacacgg

SEQ ID NO: 221413 - DNA, 25 bp, E. coli
cacggtattggtgtggtggcactac

SEQ ID NO: 221414 - DNA, 25 bp, E. coli
cacggtattggtctggtggcactac

SEQ ID NO: 221415 - DNA, 25 bp, E. coli
cagcctcggcgcaattgaacagtgg

SEQ ID NO: 221416 - DNA, 25 bp, E. coli
cagcctcggcgctattgaacagtgg

SEQ ID NO: 221417 - DNA, 25 bp, E. coli
tgacgcctgtgctgagatgttcgcc

SEQ ID NO: 221418 - DNA, 25 bp, E. coli
tgacgcctgtgcagagatgttcgcc

SEQ ID NO: 221419 - DNA, 25 bp, E. coli
tgccgatgggctactggaaaggttc

SEQ ID NO: 221420 - DNA, 25 bp, E. coli
tgccgatgggcttctggaaaggttc

SEQ ID NO: 221421 - DNA, 25 bp, E. coli
gaatccggcgttaattctcacggcg

SEQ ID NO: 221422 - DNA, 25 bp, E. coli
gcaggcggcggaaaaaggctatatt

SEQ ID NO: 221423 - DNA, 25 bp, E. coli
gaatccggcgtttattctcacggcg

SEQ ID NO: 221424 - DNA, 25 bp, E. coli
gcaggcggcggataaaggctatatt

SEQ ID NO: 221425 - DNA, 25 bp, E. coli
cgaaaaagatgatggatcgcgccat

SEQ ID NO: 221426 - DNA, 25 bp, E. coli
cgaaaaagatgaaggatcgcgccat

SEQ ID NO: 221427 - DNA, 25 bp, E. coli
ggcaatttgaccaaagaacctggcg

SEQ ID NO: 221428 - DNA, 25 bp, E. coli
ggcaatttgacctaagaacctggcg

SEQ ID NO: 221429 - DNA, 25 bp, E. coli
taatcgggtctttatttcacgcggc

SEQ ID NO: 221430 - DNA, 25 bp, E. coli
taatgccaaccagtggatgcgcggc

SEQ ID NO: 221431 - DNA, 25 bp, E. coli
tcaacaactggaaaacggcgatatc

SEQ ID NO: 221432 - DNA, 25 bp, E. coli
taatcgggtcttaatttcacgcggc

SEQ ID NO: 221433 - DNA, 25 bp, E. coli
tcaacaactggataacggcgatatc

SEQ ID NO: 221434 - DNA, 25 bp, E. coli
taatgccaaccactggatgcgcggc

SEQ ID NO: 221435 - DNA, 25 bp, E. coli
caataagaaaaattccgtgcgctga

SEQ ID NO: 221436 - DNA, 25 bp, E. coli
caataagaaaaaatccgtgcgctga

SEQ ID NO: 221437 - DNA, 25 bp, E. coli
ccggcaaaatttctccaacctgttg

SEQ ID NO: 221438 - DNA, 25 bp, E. coli
ccggcaaaatttgtccaacctgttg

SEQ ID NO: 221439 - DNA, 25 bp, E. coli
tgtgcgtaatttgtccagtctgctg

SEQ ID NO: 221440 - DNA, 25 bp, E. coli
tgtgcgtaatttctccagtctgctg

SEQ ID NO: 221441 - DNA, 25 bp, E. coli
tccgccactctgtgccggtttactg

SEQ ID NO: 221442 - DNA, 25 bp, E. coli
tccgccactctgagccggtttactg

SEQ ID NO: 221443 - DNA, 25 bp, E. coli
tctccagtctgcaggacgaggagcg

SEQ ID NO: 221444 - DNA, 25 bp, E. coli
tctccagtctgctggacgaggagcg

SEQ ID NO: 221445 - DNA, 25 bp, E. coli
cctgagcaacgacactgattccagt

SEQ ID NO: 221446 - DNA, 25 bp, E. coli
ccagtatctaagactggagtccagt

SEQ ID NO: 221447 - DNA, 25 bp, E. coli
cctgagcaacgagactgattccagt

SEQ ID NO: 221448 - DNA, 25 bp, E. coli
ccaacctgttgtactcaataagaaa

SEQ ID NO: 221449 - DNA, 25 bp, E. coli
ccagtatctaagtctggagtccagt

SEQ ID NO: 221450 - DNA, 25 bp, E. coli
ccaacctgttgttctcaataagaaa

SEQ ID NO: 221451 - DNA, 25 bp, E. coli
cgtgcgctgattcacaaatttgtgc

SEQ ID NO: 221452 - DNA, 25 bp, E. coli
cgtgcgctgattgacaaatttgtgc

SEQ ID NO: 221453 - DNA, 25 bp, E. coli
gagcgggatttgttgcgcttcacaa

SEQ ID NO: 221454 - DNA, 25 bp, E. coli
gatgcgcttcactattttactcccc

SEQ ID NO: 221455 - DNA, 25 bp, E. coli
gatgcgcttcacaattttactcccc

SEQ ID NO: 221456 - DNA, 25 bp, E. coli
gagcgggatttgatgcgcttcacaa

SEQ ID NO: 221457 - DNA, 25 bp, E. coli
caatgactcgtaaaatttgggccaa

SEQ ID NO: 221458 - DNA, 25 bp, E. coli
caatgactcgtataatttgggccaa

SEQ ID NO: 221459 - DNA, 25 bp, E. coli
cacactttttccctttgctgtggtc

SEQ ID NO: 221460 - DNA, 25 bp, E. coli
cacactttttccgtttgctgtggtc

SEQ ID NO: 221461 - DNA, 25 bp, E. coli
tactgctttttgtaacgctaaagtc

SEQ ID NO: 221462 - DNA, 25 bp, E. coli
tactgctttttgaaacgctaaagtc

SEQ ID NO: 221463 - DNA, 25 bp, E. coli
tattcgcgcgtgtagattttactta

SEQ ID NO: 221464 - DNA, 25 bp, E. coli
tattcgcgcgtgaagattttactta

SEQ ID NO: 221465 - DNA, 25 bp, E. coli
tgcatcaaacgcatcaacgaaatgt

SEQ ID NO: 221466 - DNA, 25 bp, E. coli
tgcatcaaacgcttcaacgaaatgt

SEQ ID NO: 221467 - DNA, 25 bp, E. coli
tcagccgcgagctactgggcttcag

SEQ ID NO: 221468 - DNA, 25 bp, E. coli
gctgtggtctacttattcgcgcgtg

SEQ ID NO: 221469 - DNA, 25 bp, E. coli
gctgtggtctacatattcgcgcgtg

SEQ ID NO: 221470 - DNA, 25 bp, E. coli
gcactttttcccagccgggcctgaa

SEQ ID NO: 221471 - DNA, 25 bp, E. coli
gcactttttccctgccgggcctgaa

SEQ ID NO: 221472 - DNA, 25 bp, E. coli
cgggcctgaaaacccactaagcagg

SEQ ID NO: 221473 - DNA, 25 bp, E. coli
cgggcctgaaaagccactaagcagg

SEQ ID NO: 221474 - DNA, 25 bp, E. coli
gggcttcagcttgcgtgtgcatcaa

SEQ ID NO: 221475 - DNA, 25 bp, E. coli
gggcttcagcttccgtgtgcatcaa

SEQ ID NO: 221476 - DNA, 25 bp, E. coli
tcagccgcgagcaactgggcttcag

SEQ ID NO: 221477 - DNA, 25 bp, E. coli
gattttacttatctgactacctccg

SEQ ID NO: 221478 - DNA, 25 bp, E. coli
gattttacttatgtgactacctccg

SEQ ID NO: 221479 - DNA, 25 bp, E. coli
aacgtcagcaatacccggtgcgtaa

SEQ ID NO: 221480 - DNA, 25 bp, E. coli
taaagcaaagggtggcaggcaaaag

SEQ ID NO: 221481 - DNA, 25 bp, E. coli
aacgtcagcaattcccggtgcgtaa

SEQ ID NO: 221482 - DNA, 25 bp, E. coli
tagttggtgttgatgatcagtgtaa

SEQ ID NO: 221483 - DNA, 25 bp, E. coli
tagttggtgttgttgatcagtgtaa

SEQ ID NO: 221484 - DNA, 25 bp, E. coli
tatctggaacgtcagcaattcccgg

SEQ ID NO: 221485 - DNA, 25 bp, E. coli
tatctggaacgtgagcaattcccgg

SEQ ID NO: 221486 - DNA, 25 bp, E. coli
ttcccggtgcgtaaagcaaagggag

SEQ ID NO: 221487 - DNA, 25 bp, E. coli
ttcccggtgcgttaagcaaagggag

SEQ ID NO: 221488 - DNA, 25 bp, E. coli
tcagtgtaaggaccataaggaatga

SEQ ID NO: 221489 - DNA, 25 bp, E. coli
tcagtgtaaggagcataaggaatga

SEQ ID NO: 221490 - DNA, 25 bp, E. coli
gatgatcagtgtaaggagcataagg

SEQ ID NO: 221491 - DNA, 25 bp, E. coli
gcaattcccggtccgtaaagcaaag

SEQ ID NO: 221492 - DNA, 25 bp, E. coli
gcaattcccggtgcgtaaagcaaag

SEQ ID NO: 221493 - DNA, 25 bp, E. coli
gatgatcagtgttaggagcataagg

SEQ ID NO: 221494 - DNA, 25 bp, E. coli
ctggcgtaaggtttcacgatctgca

SEQ ID NO: 221495 - DNA, 25 bp, E. coli
ctggcgtaaggtatcacgatctgca

SEQ ID NO: 221496 - DNA, 25 bp, E. coli
gggctggcgtaaggtttcacgatct

SEQ ID NO: 221497 - DNA, 25 bp, E. coli
gggctggcgtaacgtttcacgatct

SEQ ID NO: 221498 - DNA, 25 bp, E. coli
tggaacgtcagctattcccggtgcg

SEQ ID NO: 221499 - DNA, 25 bp, E. coli
tggaacgtcagcaattcccggtgcg

SEQ ID NO: 221500 - DNA, 25 bp, E. coli
taaagcaaagggaggcaggcaaaag

SEQ ID NO: 221501 - DNA, 25 bp, E. coli
cacaacgtgcgtcaaacactggcgg

SEQ ID NO: 221502 - DNA, 25 bp, E. coli
cagcgtttacgataacctgatggcg

SEQ ID NO: 221503 - DNA, 25 bp, E. coli
cacattgagcacctgcgtgacagca

SEQ ID NO: 221504 - DNA, 25 bp, E. coli
cagcgtttacgaaaacctgatggcg

SEQ ID NO: 221505 - DNA, 25 bp, E. coli
cacaacgtgcgtgaaacactggcgg

SEQ ID NO: 221506 - DNA, 25 bp, E. coli
cacattgagcacgtgcgtgacagca

SEQ ID NO: 221507 - DNA, 25 bp, E. coli
accgcgcgaacgagctgatggaaga

SEQ ID NO: 221508 - DNA, 25 bp, E. coli
aaacactggcggattgtgaacgcgc

SEQ ID NO: 221509 - DNA, 25 bp, E. coli
aaacactggcggtttgtgaacgcgc

SEQ ID NO: 221510 - DNA, 25 bp, E. coli
accgcgcgaacgtgctgatggaaga

SEQ ID NO: 221511 - DNA, 25 bp, E. coli
aacgtcgccgtgaagaaattgcccg

SEQ ID NO: 221512 - DNA, 25 bp, E. coli
aacgtcgccgtgtagaaattgcccg

SEQ ID NO: 221513 - DNA, 25 bp, E. coli
cctataaaggccgtcgcgtggtaga

SEQ ID NO: 221514 - DNA, 25 bp, E. coli
cctataaaggccctcgcgtggtaga

SEQ ID NO: 221515 - DNA, 25 bp, E. coli
gcactggctgcgaatccgaaattta

SEQ ID NO: 221516 - DNA, 25 bp, E. coli
gcactggctgcgtatccgaaattta

SEQ ID NO: 221517 - DNA, 25 bp, E. coli
gaaatttattctgctcgacgaaccg

SEQ ID NO: 221518 - DNA, 25 bp, E. coli
gaaatttattctcctcgacgaaccg

SEQ ID NO: 221519 - DNA, 25 bp, E. coli
gaacgcgcttatttcgtcagtcagg

SEQ ID NO: 221520 - DNA, 25 bp, E. coli
gaacgcgcttatatcgtcagtcagg

SEQ ID NO: 221521 - DNA, 25 bp, E. coli
gatggcggtactgcaaattcgtgac

SEQ ID NO: 221522 - DNA, 25 bp, E. coli
gatggcggtactccaaattcgtgac

SEQ ID NO: 221523 - DNA, 25 bp, E. coli
gaagtcggtgctagccggtttaccg

SEQ ID NO: 221524 - DNA, 25 bp, E. coli
gaagtcggtgcttgccggtttaccg

SEQ ID NO: 221525 - DNA, 25 bp, E. coli
cacaggaaattgcagagatggaccc

SEQ ID NO: 221526 - DNA, 25 bp, E. coli
cacaggaaattggagagatggaccc

SEQ ID NO: 221527 - DNA, 25 bp, E. coli
cattatggatatggatgtaaacgcg

SEQ ID NO: 221528 - DNA, 25 bp, E. coli
tacacgcctgcacgccattatggat

SEQ ID NO: 221529 - DNA, 25 bp, E. coli
tacacgcctgcaggccattatggat

SEQ ID NO: 221530 - DNA, 25 bp, E. coli
taaacgcgatgatgaccgtgatccc

SEQ ID NO: 221531 - DNA, 25 bp, E. coli
taaacgcgatgaagaccgtgatccc

SEQ ID NO: 221532 - DNA, 25 bp, E. coli
agatggacccgggagatctcactgc

SEQ ID NO: 221533 - DNA, 25 bp, E. coli
agatggacccggcagatctcactgc

SEQ ID NO: 221534 - DNA, 25 bp, E. coli
actgccatgtcgcttgaggttgtca

SEQ ID NO: 221535 - DNA, 25 bp, E. coli
actgccatgtcggttgaggttgtca

SEQ ID NO: 221536 - DNA, 25 bp, E. coli
tccagtccggcagtgactgcacagg

SEQ ID NO: 221537 - DNA, 25 bp, E. coli
tgcgtaaaccgcagtccggtgcgct

SEQ ID NO: 221538 - DNA, 25 bp, E. coli
tccagtccggcactgactgcacagg

SEQ ID NO: 221539 - DNA, 25 bp, E. coli
tgcgtaaaccgctgtccggtgcgct

SEQ ID NO: 221540 - DNA, 25 bp, E. coli
gaaatcaccgaaattgtgctgcgta

SEQ ID NO: 221541 - DNA, 25 bp, E. coli
gaaatcaccgaatttgtgctgcgta

SEQ ID NO: 221542 - DNA, 25 bp, E. coli
cattatggatatcgatgtaaacgcg

SEQ ID NO: 221543 - DNA, 25 bp, E. coli
tcaagcgcggtaaaacagaaatcac

SEQ ID NO: 221544 - DNA, 25 bp, E. coli
tcaagcgcggtataacagaaatcac

SEQ ID NO: 221545 - DNA, 25 bp, E. coli
atcactgtcgcgtttcgtaacctcg

SEQ ID NO: 221546 - DNA, 25 bp, E. coli
ataatatggaattgtgtgctgacgc

SEQ ID NO: 221547 - DNA, 25 bp, E. coli
atcactgtcgcgattcgtaacctcg

SEQ ID NO: 221548 - DNA, 25 bp, E. coli
ataatatggaatagtgtgctgacgc

SEQ ID NO: 221549 - DNA, 25 bp, E. coli
aaatggcgttatgacctggaatata

SEQ ID NO: 221550 - DNA, 25 bp, E. coli
aaatggcgttatcacctggaatata

SEQ ID NO: 221551 - DNA, 25 bp, E. coli
tatgcatttaaaaaactcaatggcc

SEQ ID NO: 221552 - DNA, 25 bp, E. coli
tatgcatttaaataactcaatggcc

SEQ ID NO: 221553 - DNA, 25 bp, E. coli
tgcctggcttttgggctgaattatc

SEQ ID NO: 221554 - DNA, 25 bp, E. coli
tgcccgccagtcatcaggcgatatt

SEQ ID NO: 221555 - DNA, 25 bp, E. coli
tgcccgccagtcttcaggcgatatt

SEQ ID NO: 221556 - DNA, 25 bp, E. coli
tgcctggcttttcggctgaattatc

SEQ ID NO: 221557 - DNA, 25 bp, E. coli
gcataaaattaaacgtagcgccaaa

SEQ ID NO: 221558 - DNA, 25 bp, E. coli
gcataaaattaatcgtagcgccaaa

SEQ ID NO: 221559 - DNA, 25 bp, E. coli
gttgcttagcattatcactgtcgcg

SEQ ID NO: 221560 - DNA, 25 bp, E. coli
gataacggtatcaacgacgccatga

SEQ ID NO: 221561 - DNA, 25 bp, E. coli
gatagtcaaaacacatgcctcgctg

SEQ ID NO: 221562 - DNA, 25 bp, E. coli
gatagtcaaaactcatgcctcgctg

SEQ ID NO: 221563 - DNA, 25 bp, E. coli
gataacggtatctacgacgccatga

SEQ ID NO: 221564 - DNA, 25 bp, E. coli
gttgcttagcataatcactgtcgcg

SEQ ID NO: 221565 - DNA, 25 bp, E. coli
gggtatctaccagcaataatatgga

SEQ ID NO: 221566 - DNA, 25 bp, E. coli
gggtatctaccaccaataatatgga

SEQ ID NO: 221567 - DNA, 25 bp, E. coli
caaatggtataaaaatgagcaatcc

SEQ ID NO: 221568 - DNA, 25 bp, E. coli
caaatggtataataatgagcaatcc

SEQ ID NO: 221569 - DNA, 25 bp, E. coli
cagttgcaatcttattttggagaac

SEQ ID NO: 221570 - DNA, 25 bp, E. coli
cagttgcaatctaattttggagaac

SEQ ID NO: 221571 - DNA, 25 bp, E. coli
tactgtctagtaaacagcatgcctc

SEQ ID NO: 221572 - DNA, 25 bp, E. coli
taaaaatgagcattcctaatccatg

SEQ ID NO: 221573 - DNA, 25 bp, E. coli
tactgtctagtatacagcatgcctc

SEQ ID NO: 221574 - DNA, 25 bp, E. coli
taaaaatgagcaatcctaatccatg

SEQ ID NO: 221575 - DNA, 25 bp, E. coli
tagtaaacagcaagcctctatccat

SEQ ID NO: 221576 - DNA, 25 bp, E. coli
tagtaaacagcatgcctctatccat

SEQ ID NO: 221577 - DNA, 25 bp, E. coli
ttggcatgctttttactgtctagta

SEQ ID NO: 221578 - DNA, 25 bp, E. coli
ttggcatgctttatactgtctagta

SEQ ID NO: 221579 - DNA, 25 bp, E. coli
tcctaatccatgcatgacggactgg

SEQ ID NO: 221580 - DNA, 25 bp, E. coli
tcctaatccatggatgacggactgg

SEQ ID NO: 221581 - DNA, 25 bp, E. coli
tcttctccctttaagcaaatcgcta

SEQ ID NO: 221582 - DNA, 25 bp, E. coli
tctatccataaaatcaaacagttgc

SEQ ID NO: 221583 - DNA, 25 bp, E. coli
tctatccataaattcaaacagttgc

SEQ ID NO: 221584 - DNA, 25 bp, E. coli
tcttctcccttttagcaaatcgcta

SEQ ID NO: 221585 - DNA, 25 bp, E. coli
gacggactggagaaagtattcgcaa

SEQ ID NO: 221586 - DNA, 25 bp, E. coli
gacggactggagtaagtattcgcaa

SEQ ID NO: 221587 - DNA, 25 bp, E. coli
cgcaaaagttaatatcaacagtctg

SEQ ID NO: 221588 - DNA, 25 bp, E. coli
cgcaaaagttaaaatcaacagtctg

SEQ ID NO: 221589 - DNA, 25 bp, E. coli
caagacactgatgcctggtgcggac

SEQ ID NO: 221590 - DNA, 25 bp, E. coli
caagacactgatccctggtgcggac

SEQ ID NO: 221591 - DNA, 25 bp, E. coli
aaatcgccatgcaaagccgtctgaa

SEQ ID NO: 221592 - DNA, 25 bp, E. coli
aaatcgccatgctaagccgtctgaa

SEQ ID NO: 221593 - DNA, 25 bp, E. coli
tatcggcactaaaggcaagacactg

SEQ ID NO: 221594 - DNA, 25 bp, E. coli
tatcggcactaatggcaagacactg

SEQ ID NO: 221595 - DNA, 25 bp, E. coli
tgccgccgatggaacgtattgagcc

SEQ ID NO: 221596 - DNA, 25 bp, E. coli
tctactataacgtgcgggaaattcc

SEQ ID NO: 221597 - DNA, 25 bp, E. coli
tgccgccgatggtacgtattgagcc

SEQ ID NO: 221598 - DNA, 25 bp, E. coli
tctactataacgagcgggaaattcc

SEQ ID NO: 221599 - DNA, 25 bp, E. coli
tctggcgaccgaaagcgattgagtt

SEQ ID NO: 221600 - DNA, 25 bp, E. coli
tctggcgaccgatagcgattgagtt

SEQ ID NO: 221601 - DNA, 25 bp, E. coli
ccagttaggcttagtggcggactac

SEQ ID NO: 221602 - DNA, 25 bp, E. coli
ccagttaggctttgtggcggactac

SEQ ID NO: 221603 - DNA, 25 bp, E. coli
gccgcgtgccaaagaacagaatgtc

SEQ ID NO: 221604 - DNA, 25 bp, E. coli
gccgcgtgccaatgaacagaatgtc

SEQ ID NO: 221605 - DNA, 25 bp, E. coli
gattatatttcatcactgccgccga

SEQ ID NO: 221606 - DNA, 25 bp, E. coli
gattatatttcaacactgccgccga

SEQ ID NO: 221607 - DNA, 25 bp, E. coli
tggcgctggcctggttaaataactt

SEQ ID NO: 221608 - DNA, 25 bp, E. coli
tggcgctggcctcgttaaataactt

SEQ ID NO: 221609 - DNA, 25 bp, E. coli
gatggttcctctccaaaaagtgacg

SEQ ID NO: 221610 - DNA, 25 bp, E. coli
gatggttcctctgcaaaaagtgacg

SEQ ID NO: 221611 - DNA, 25 bp, E. coli
cactgaagcgaatgcagatgacctg

SEQ ID NO: 221612 - DNA, 25 bp, E. coli
cactgaagcgaaagcagatgacctg

SEQ ID NO: 221613 - DNA, 25 bp, E. coli
caggaaacggctccacaggaagaaa

SEQ ID NO: 221614 - DNA, 25 bp, E. coli
caggaaacggctgcacaggaagaaa

SEQ ID NO: 221615 - DNA, 25 bp, E. coli
actggcattgatgttcggaattacc

SEQ ID NO: 221616 - DNA, 25 bp, E. coli
aaagcagcatccctagctgaaacgg

SEQ ID NO: 221617 - DNA, 25 bp, E. coli
actggcattgatcttcggaattacc

SEQ ID NO: 221618 - DNA, 25 bp, E. coli
aaagcagcatccgtagctgaaacgg

SEQ ID NO: 221619 - DNA, 25 bp, E. coli
tagctgaaacggtgggtaaagccct

SEQ ID NO: 221620 - DNA, 25 bp, E. coli
tagctgaaacggagggtaaagccct

SEQ ID NO: 221621 - DNA, 25 bp, E. coli
tgaacaaacacagggatattctccg

SEQ ID NO: 221622 - DNA, 25 bp, E. coli
tgaacaaacacacggatattctccg

SEQ ID NO: 221623 - DNA, 25 bp, E. coli
tgcgttaccagtccaggaaacggct

SEQ ID NO: 221624 - DNA, 25 bp, E. coli
tgcgttaccagtgcaggaaacggct

SEQ ID NO: 221625 - DNA, 25 bp, E. coli
tctgtgctgcgcaacgggaactgaa

SEQ ID NO: 221626 - DNA, 25 bp, E. coli
tctgtgctgcgctacgggaactgaa

SEQ ID NO: 221627 - DNA, 25 bp, E. coli
gaagttgcagcattcgttcactgaa

SEQ ID NO: 221628 - DNA, 25 bp, E. coli
gaagttgcagcaatcgttcactgaa

SEQ ID NO: 221629 - DNA, 25 bp, E. coli
gaaattaaaacagaagcggtggagg

SEQ ID NO: 221630 - DNA, 25 bp, E. coli
gaaattaaaacacaagcggtggagg

SEQ ID NO: 221631 - DNA, 25 bp, E. coli
gacctgattctagcatcgctgcatg

SEQ ID NO: 221632 - DNA, 25 bp, E. coli
gacctgattctaccatcgctgcatg

SEQ ID NO: 221633 - DNA, 25 bp, E. coli
cacagaggattctatgagcgaaaaa

SEQ ID NO: 221634 - DNA, 25 bp, E. coli
cacagaggattcaatgagcgaaaaa

SEQ ID NO: 221635 - DNA, 25 bp, E. coli
cacatatttgtgagttaccgtattc

SEQ ID NO: 221636 - DNA, 25 bp, E. coli
cacatatttgtgtgttaccgtattc

SEQ ID NO: 221637 - DNA, 25 bp, E. coli
taaacacactttttcgatacacaca

SEQ ID NO: 221638 - DNA, 25 bp, E. coli
tactgcctggcagagaggattcaat

SEQ ID NO: 221639 - DNA, 25 bp, E. coli
tactgcctggcacagaggattcaat

SEQ ID NO: 221640 - DNA, 25 bp, E. coli
taaacacactttatcgatacacaca

SEQ ID NO: 221641 - DNA, 25 bp, E. coli
aaaggatctagtcacttattgtaac

SEQ ID NO: 221642 - DNA, 25 bp, E. coli
aaagctgcgggaatgtactgcctgg

SEQ ID NO: 221643 - DNA, 25 bp, E. coli
aaagctgcgggattgtactgcctgg

SEQ ID NO: 221644 - DNA, 25 bp, E. coli
aaaggatctagtgacttattgtaac

SEQ ID NO: 221645 - DNA, 25 bp, E. coli
ttaatcaaaattcccaaagctgcgg

SEQ ID NO: 221646 - DNA, 25 bp, E. coli
ttaatcaaaattgccaaagctgcgg

SEQ ID NO: 221647 - DNA, 25 bp, E. coli
tcatcgcaaaagagattactgtcac

SEQ ID NO: 221648 - DNA, 25 bp, E. coli
tcatcgcaaaagtgattactgtcac

SEQ ID NO: 221649 - DNA, 25 bp, E. coli
gattactgtcactttcacatatttg

SEQ ID NO: 221650 - DNA, 25 bp, E. coli
gattactgtcacattcacatatttg

SEQ ID NO: 221651 - DNA, 25 bp, E. coli
taagtacagttatcatcgcaaaaga

SEQ ID NO: 221652 - DNA, 25 bp, E. coli
taagtacagttaacatcgcaaaaga

SEQ ID NO: 221653 - DNA, 25 bp, E. coli
gagttaccgtattctcatggtttct

SEQ ID NO: 221654 - DNA, 25 bp, E. coli
gagttaccgtatactcatggtttct

SEQ ID NO: 221655 - DNA, 25 bp, E. coli
caattatcaaaactctctgggcggt

SEQ ID NO: 221656 - DNA, 25 bp, E. coli
caattatcaaaagtctctgggcggt

SEQ ID NO: 221657 - DNA, 25 bp, E. coli
agacgaaaaaatcggaccagagcca

SEQ ID NO: 221658 - DNA, 25 bp, E. coli
agacgaaaaaatgggaccagagcca

SEQ ID NO: 221659 - DNA, 25 bp, E. coli
tatgtacggccattgacgtccacct

SEQ ID NO: 221660 - DNA, 25 bp, E. coli
tatgtacggccaatgacgtccacct

SEQ ID NO: 221661 - DNA, 25 bp, E. coli
tgctgcacaccataacctggtttga

SEQ ID NO: 221662 - DNA, 25 bp, E. coli
tgctgcacaccaaaacctggtttga

SEQ ID NO: 221663 - DNA, 25 bp, E. coli
tctctgggcggtaactgtggttgcc

SEQ ID NO: 221664 - DNA, 25 bp, E. coli
tctctgggcggttactgtggttgcc

SEQ ID NO: 221665 - DNA, 25 bp, E. coli
ccggctgtgtggttcagcattgaac

SEQ ID NO: 221666 - DNA, 25 bp, E. coli
ccggctgtgtggatcagcattgaac

SEQ ID NO: 221667 - DNA, 25 bp, E. coli
gcctgggcgggattcgtcgactttt

SEQ ID NO: 221668 - DNA, 25 bp, E. coli
gcctgggcgggaatcgtcgactttt

SEQ ID NO: 221669 - DNA, 25 bp, E. coli
cttttacatgctgcgcgaaggcacg

SEQ ID NO: 221670 - DNA, 25 bp, E. coli
cattaacctgatgactctggcggca

SEQ ID NO: 221671 - DNA, 25 bp, E. coli
cttttacatgctccgcgaaggcacg

SEQ ID NO: 221672 - DNA, 25 bp, E. coli
cattaacctgatcactctggcggca

SEQ ID NO: 221673 - DNA, 25 bp, E. coli
gtccacctggtgcaaaaaattgccg

SEQ ID NO: 221674 - DNA, 25 bp, E. coli
gtccacctggtggaaaaaattgccg

SEQ ID NO: 221675 - DNA, 25 bp, E. coli
tggttgccaccatcgtaatcctgtt

SEQ ID NO: 221676 - DNA, 25 bp, E. coli
tggttgccaccaacgtaatcctgtt

SEQ ID NO: 221677 - DNA, 25 bp, E. coli
cagccctggcggtaagtcaaagcaa

SEQ ID NO: 221678 - DNA, 25 bp, E. coli
cagccctggcggaaagtcaaagcaa

SEQ ID NO: 221679 - DNA, 25 bp, E. coli
tagcaggtttgatagcggcaccgtg

SEQ ID NO: 221680 - DNA, 25 bp, E. coli
tagcaggtttgaaagcggcaccgtg

SEQ ID NO: 221681 - DNA, 25 bp, E. coli
tttctgcccggaaattgaacgcggc

SEQ ID NO: 221682 - DNA, 25 bp, E. coli
tattaccgatcgtccgcagttggcc

SEQ ID NO: 221683 - DNA, 25 bp, E. coli
tattaccgatcgaccgcagttggcc

SEQ ID NO: 221684 - DNA, 25 bp, E. coli
ttaagctgacggtaaaagacggcga

SEQ ID NO: 221685 - DNA, 25 bp, E. coli
tttctgcccggatattgaacgcggc

SEQ ID NO: 221686 - DNA, 25 bp, E. coli
ttatttcactggctgccgaaggcgc

SEQ ID NO: 221687 - DNA, 25 bp, E. coli
ttaagctgacggaaaaagacggcga

SEQ ID NO: 221688 - DNA, 25 bp, E. coli
ttatttcactgggtgccgaaggcgc

SEQ ID NO: 221689 - DNA, 25 bp, E. coli
tgaaaaccaccgctctgcatgcggc

SEQ ID NO: 221690 - DNA, 25 bp, E. coli
tgaaaaccaccggtctgcatgcggc

SEQ ID NO: 221691 - DNA, 25 bp, E. coli
gctttgggttaatgcctccggcgaa

SEQ ID NO: 221692 - DNA, 25 bp, E. coli
gctttgggttaaagcctccggcgaa

SEQ ID NO: 221693 - DNA, 25 bp, E. coli
cgccgactgggatcgctttgtgact

SEQ ID NO: 221694 - DNA, 25 bp, E. coli
cgccgactgggaacgctttgtgact

SEQ ID NO: 221695 - DNA, 25 bp, E. coli
ggcgcgcgtcgagttacaacctttt

SEQ ID NO: 221696 - DNA, 25 bp, E. coli
ggcgcgcgtcgacttacaacctttt

SEQ ID NO: 221697 - DNA, 25 bp, E. coli
gatgtcgtaagctccgttggcgcag

SEQ ID NO: 221698 - DNA, 25 bp, E. coli
gatgtcgtaagcaccgttggcgcag

SEQ ID NO: 221699 - DNA, 25 bp, E. coli
caacggtaaggaacatgctgacgcg

SEQ ID NO: 221700 - DNA, 25 bp, E. coli
caacggtaaggatcatgctgacgcg

SEQ ID NO: 221701 - DNA, 25 bp, E. coli
cattttgcgcgtgccctggatgctg

SEQ ID NO: 221702 - DNA, 25 bp, E. coli
tgaacgtttcgcgatactggaggcc

SEQ ID NO: 221703 - DNA, 25 bp, E. coli
tgaacgtttcgccatactggaggcc

SEQ ID NO: 221704 - DNA, 25 bp, E. coli
tgctgacgcgttaaaggatgcctgg

SEQ ID NO: 221705 - DNA, 25 bp, E. coli
tccggtcatgtatctggctgggtcg

SEQ ID NO: 221706 - DNA, 25 bp, E. coli
tgctgacgcgtttaaggatgcctgg

SEQ ID NO: 221707 - DNA, 25 bp, E. coli
tccggtcatgtaactggctgggtcg

SEQ ID NO: 221708 - DNA, 25 bp, E. coli
tacagaaaagggagcattcgcaacg

SEQ ID NO: 221709 - DNA, 25 bp, E. coli
tacagaaaagggtgcattcgcaacg

SEQ ID NO: 221710 - DNA, 25 bp, E. coli
gccgcgacgcgatacagcataactt

SEQ ID NO: 221711 - DNA, 25 bp, E. coli
gccgcgacgcgaaacagcataactt

SEQ ID NO: 221712 - DNA, 25 bp, E. coli
gacacggtaagggaatgccgcgaac

SEQ ID NO: 221713 - DNA, 25 bp, E. coli
gacacggtaaggcaatgccgcgaac

SEQ ID NO: 221714 - DNA, 25 bp, E. coli
cattttgcgcgtcccctggatgctg

SEQ ID NO: 221715 - DNA, 25 bp, E. coli
gattaaagagcttgccggatacaga

SEQ ID NO: 221716 - DNA, 25 bp, E. coli
gattaaagagctagccggatacaga

SEQ ID NO: 221717 - DNA, 25 bp, E. coli
gtggcgcaacctgataccggagagt

SEQ ID NO: 221718 - DNA, 25 bp, E. coli
gtggcgcaacctcataccggagagt

SEQ ID NO: 221719 - DNA, 25 bp, E. coli
taacgttccgatcgaaaaagccacg

SEQ ID NO: 221720 - DNA, 25 bp, E. coli
taacgttccgatggaaaaagccacg

SEQ ID NO: 221721 - DNA, 25 bp, E. coli
caatgaagcaaaatctcggtgagca

SEQ ID NO: 221722 - DNA, 25 bp, E. coli
caatgaagcaaattctcggtgagca

SEQ ID NO: 221723 - DNA, 25 bp, E. coli
tacatcgcagcttgaagaggccatc

SEQ ID NO: 221724 - DNA, 25 bp, E. coli
tacatcgcagctagaagaggccatc

SEQ ID NO: 221725 - DNA, 25 bp, E. coli
agtattattttgacagggcatggcg

SEQ ID NO: 221726 - DNA, 25 bp, E. coli
agtattattttgtcagggcatggcg

SEQ ID NO: 221727 - DNA, 25 bp, E. coli
taggccgctgccatgaagaatgtcc

SEQ ID NO: 221728 - DNA, 25 bp, E. coli
taggccgctgccttgaagaatgtcc

SEQ ID NO: 221729 - DNA, 25 bp, E. coli
tttctgacggatatgctgggcggca

SEQ ID NO: 221730 - DNA, 25 bp, E. coli
tttctgacggatttgctgggcggca

SEQ ID NO: 221731 - DNA, 25 bp, E. coli
tgccagcggcatggaaaaagcaatg

SEQ ID NO: 221732 - DNA, 25 bp, E. coli
tgccagcggcatcgaaaaagcaatg

SEQ ID NO: 221733 - DNA, 25 bp, E. coli
gctgtgaagtgatcaccggcaccaa

SEQ ID NO: 221734 - DNA, 25 bp, E. coli
gctgtgaagtgaacaccggcaccaa

SEQ ID NO: 221735 - DNA, 25 bp, E. coli
gctggcgatgcaaaaaccgggctgt

SEQ ID NO: 221736 - DNA, 25 bp, E. coli
gctggcgatgcataaaccgggctgt

SEQ ID NO: 221737 - DNA, 25 bp, E. coli
cccaactggattgtgaagacggcat

SEQ ID NO: 221738 - DNA, 25 bp, E. coli
cccaactggattctgaagacggcat

SEQ ID NO: 221739 - DNA, 25 bp, E. coli
gattttccggaaacctcaagcaccg

SEQ ID NO: 221740 - DNA, 25 bp, E. coli
gattttccggaatcctcaagcaccg

SEQ ID NO: 221741 - DNA, 25 bp, E. coli
gagcaatcgcagtttatcgccatcg

SEQ ID NO: 221742 - DNA, 25 bp, E. coli
gagcaatcgcagattatcgccatcg

SEQ ID NO: 221743 - DNA, 25 bp, E. coli
agcacgctgctctcgggctgtaaca

SEQ ID NO: 221744 - DNA, 25 bp, E. coli
agcacgctgctcacgggctgtaaca

SEQ ID NO: 221745 - DNA, 25 bp, E. coli
acaccgctcgcggtttcggcgaaga

SEQ ID NO: 221746 - DNA, 25 bp, E. coli
acaccgctcgcgctttcggcgaaga

SEQ ID NO: 221747 - DNA, 25 bp, E. coli
tatcgttcttgttttgcttgccagc

SEQ ID NO: 221748 - DNA, 25 bp, E. coli
tatcgttcttgtattgcttgccagc

SEQ ID NO: 221749 - DNA, 25 bp, E. coli
ttgcttgccagcacgctgctcacgg

SEQ ID NO: 221750 - DNA, 25 bp, E. coli
ttgcttgccagctcgctgctcacgg

SEQ ID NO: 221751 - DNA, 25 bp, E. coli
tgatgaaacgccatatcgttcttgt

SEQ ID NO: 221752 - DNA, 25 bp, E. coli
tgatgaaacgccttatcgttcttgt

SEQ ID NO: 221753 - DNA, 25 bp, E. coli
tgttttgcttgccagcacgctgctc

SEQ ID NO: 221754 - DNA, 25 bp, E. coli
tgttttgcttgcgagcacgctgctc

SEQ ID NO: 221755 - DNA, 25 bp, E. coli
tcggcgaagacaacaaacatctcgg

SEQ ID NO: 221756 - DNA, 25 bp, E. coli
tcggcgaagacatcaaacatctcgg

SEQ ID NO: 221757 - DNA, 25 bp, E. coli
gaagacatcaaagatctcggcaact

SEQ ID NO: 221758 - DNA, 25 bp, E. coli
gaagacatcaaacatctcggcaact

SEQ ID NO: 221759 - DNA, 25 bp, E. coli
gacatcaaacatgtcggcaactcca

SEQ ID NO: 221760 - DNA, 25 bp, E. coli
gacatcaaacatctcggcaactcca

SEQ ID NO: 221761 - DNA, 25 bp, E. coli
cgcggtttcggcgaagacatcaaac

SEQ ID NO: 221762 - DNA, 25 bp, E. coli
cgcggtttcggccaagacatcaaac

SEQ ID NO: 221763 - DNA, 25 bp, E. coli
cgggctgtaacagcgctcgcggttt

SEQ ID NO: 221764 - DNA, 25 bp, E. coli
cgggctgtaacaccgctcgcggttt

SEQ ID NO: 221765 - DNA, 25 bp, E. coli
aatcaaacagtcaacatcattctgg

SEQ ID NO: 221766 - DNA, 25 bp, E. coli
aatcaaacagtctacatcattctgg

SEQ ID NO: 221767 - DNA, 25 bp, E. coli
caaacgcgttcaattagcacttatc

SEQ ID NO: 221768 - DNA, 25 bp, E. coli
caaacgcgttcatttagcacttatc

SEQ ID NO: 221769 - DNA, 25 bp, E. coli
cagtgagtaccctaccattaatgcg

SEQ ID NO: 221770 - DNA, 25 bp, E. coli
cagtgagtacccaaccattaatgcg

SEQ ID NO: 221771 - DNA, 25 bp, E. coli
tccggaacgccctctcatcagtgag

SEQ ID NO: 221772 - DNA, 25 bp, E. coli
tgcgctaaatctcaagtctccggaa

SEQ ID NO: 221773 - DNA, 25 bp, E. coli
tgcgctaaatctgaagtctccggaa

SEQ ID NO: 221774 - DNA, 25 bp, E. coli
tccggaacgcccactcatcagtgag

SEQ ID NO: 221775 - DNA, 25 bp, E. coli
gcatatcccggtttttcaatgagat

SEQ ID NO: 221776 - DNA, 25 bp, E. coli
gcatatcccggtatttcaatgagat

SEQ ID NO: 221777 - DNA, 25 bp, E. coli
gctcaactggtatcagactgggctg

SEQ ID NO: 221778 - DNA, 25 bp, E. coli
gctcaactggtaacagactgggctg

SEQ ID NO: 221779 - DNA, 25 bp, E. coli
gcacgttatcacgatgctcaactgg

SEQ ID NO: 221780 - DNA, 25 bp, E. coli
gcacgttatcaccatgctcaactgg

SEQ ID NO: 221781 - DNA, 25 bp, E. coli
gactgggctgaagtcgttaatatca

SEQ ID NO: 221782 - DNA, 25 bp, E. coli
cattaatgcgttaagcatatcccgg

SEQ ID NO: 221783 - DNA, 25 bp, E. coli
cattctggatggtgcacgttatcac

SEQ ID NO: 221784 - DNA, 25 bp, E. coli
cattctggatggagcacgttatcac

SEQ ID NO: 221785 - DNA, 25 bp, E. coli
cattaatgcgtttagcatatcccgg

SEQ ID NO: 221786 - DNA, 25 bp, E. coli
gactgggctgaactcgttaatatca

SEQ ID NO: 221787 - DNA, 25 bp, E. coli
cacacgcattgcatgcaggaacaga

SEQ ID NO: 221788 - DNA, 25 bp, E. coli
cacacgcattgcttgcaggaacaga

SEQ ID NO: 221789 - DNA, 25 bp, E. coli
caggtagccagctcgcatcatgttg

SEQ ID NO: 221790 - DNA, 25 bp, E. coli
caggtagccagcacgcatcatgttg

SEQ ID NO: 221791 - DNA, 25 bp, E. coli
tgaatgctgcggatacgaagccgag

SEQ ID NO: 221792 - DNA, 25 bp, E. coli
tgaatgctgcggttacgaagccgag

SEQ ID NO: 221793 - DNA, 25 bp, E. coli
ccaatgctctgaagacctgcgataa

SEQ ID NO: 221794 - DNA, 25 bp, E. coli
ccaatgctctgatgacctgcgataa

SEQ ID NO: 221795 - DNA, 25 bp, E. coli
gctacgcggttgtatttcgggctaa

SEQ ID NO: 221796 - DNA, 25 bp, E. coli
gctaagttggatctagagcactgcc

SEQ ID NO: 221797 - DNA, 25 bp, E. coli
gctaagttggatgtagagcactgcc

SEQ ID NO: 221798 - DNA, 25 bp, E. coli
gctacgcggttgaatttcgggctaa

SEQ ID NO: 221799 - DNA, 25 bp, E. coli
gaaacgtggatccaggaaatcgctg

SEQ ID NO: 221800 - DNA, 25 bp, E. coli
gaacgatgatggacagtacctggcc

SEQ ID NO: 221801 - DNA, 25 bp, E. coli
gaacgatgatggtcagtacctggcc

SEQ ID NO: 221802 - DNA, 25 bp, E. coli
gaaacgtggatcgaggaaatcgctg

SEQ ID NO: 221803 - DNA, 25 bp, E. coli
gttatcagcagcgttatccgcagcg

SEQ ID NO: 221804 - DNA, 25 bp, E. coli
gttatcagcagccttatccgcagcg

SEQ ID NO: 221805 - DNA, 25 bp, E. coli
ggcgcaactgcaccaccgatgttca

SEQ ID NO: 221806 - DNA, 25 bp, E. coli
ggcgcaactgcagcaccgatgttca

SEQ ID NO: 221807 - DNA, 25 bp, E. coli
gagatcgttgttaccagctgcctga

SEQ ID NO: 221808 - DNA, 25 bp, E. coli
gagatcgttgtttccagctgcctga

SEQ ID NO: 221809 - DNA, 25 bp, E. coli
aagatgcgcagaaagatgtcggtga

SEQ ID NO: 221810 - DNA, 25 bp, E. coli
aagatgcgcagatagatgtcggtga

SEQ ID NO: 221811 - DNA, 25 bp, E. coli
agtatggtacgagcgttatcgcagg

SEQ ID NO: 221812 - DNA, 25 bp, E. coli
agtatggtacgaccgttatcgcagg

SEQ ID NO: 221813 - DNA, 25 bp, E. coli
tatgcgcggttagaaagcggctatc

SEQ ID NO: 221814 - DNA, 25 bp, E. coli
tatgcgcggttacaaagcggctatc

SEQ ID NO: 221815 - DNA, 25 bp, E. coli
tattgccacgatcatgagcattcga

SEQ ID NO: 221816 - DNA, 25 bp, E. coli
tatcatcccaaataactatgcgcgg

SEQ ID NO: 221817 - DNA, 25 bp, E. coli
tattgccacgatgatgagcattcga

SEQ ID NO: 221818 - DNA, 25 bp, E. coli
tatcatcccaaaaaactatgcgcgg

SEQ ID NO: 221819 - DNA, 25 bp, E. coli
ttaaaaatctatgcgtgggtctgcg

SEQ ID NO: 221820 - DNA, 25 bp, E. coli
ttaaaaatctatccgtgggtctgcg

SEQ ID NO: 221821 - DNA, 25 bp, E. coli
tgttcccgcgagtttgtttattcca

SEQ ID NO: 221822 - DNA, 25 bp, E. coli
tgttcccgcgagattgtttattcca

SEQ ID NO: 221823 - DNA, 25 bp, E. coli
tgtcggtgaagccaagtacaaccca

SEQ ID NO: 221824 - DNA, 25 bp, E. coli
tgtcggtgaagcgaagtacaaccca

SEQ ID NO: 221825 - DNA, 25 bp, E. coli
gcggctatcgcgaaaaagcattaaa

SEQ ID NO: 221826 - DNA, 25 bp, E. coli
gcggctatcgcgtaaaagcattaaa

SEQ ID NO: 221827 - DNA, 25 bp, E. coli
ccgaagcggatctgtatggtacgac

SEQ ID NO: 221828 - DNA, 25 bp, E. coli
ccgaagcggatcagtatggtacgac

SEQ ID NO: 221829 - DNA, 25 bp, E. coli
taacccggaagatggcagtaactgg

SEQ ID NO: 221830 - DNA, 25 bp, E. coli
taacccggaagaaggcagtaactgg

SEQ ID NO: 221831 - DNA, 25 bp, E. coli
catgacgcctacatctataaaggac

SEQ ID NO: 221832 - DNA, 25 bp, E. coli
catgacgcctacttctataaaggac

SEQ ID NO: 221833 - DNA, 25 bp, E. coli
aaatacatctggactccccatgacg

SEQ ID NO: 221834 - DNA, 25 bp, E. coli
aaatacatctggtctccccatgacg

SEQ ID NO: 221835 - DNA, 25 bp, E. coli
aaaaccatatggtatgtcaaaaccg

SEQ ID NO: 221836 - DNA, 25 bp, E. coli
aaatggaaattaaccgcatgacggc

SEQ ID NO: 221837 - DNA, 25 bp, E. coli
aaaaccatatggaatgtcaaaaccg

SEQ ID NO: 221838 - DNA, 25 bp, E. coli
aaatggaaattatccgcatgacggc

SEQ ID NO: 221839 - DNA, 25 bp, E. coli
tatgtgattaatcgcaggttcctga

SEQ ID NO: 221840 - DNA, 25 bp, E. coli
tatgtgattaatggcaggttcctga

SEQ ID NO: 221841 - DNA, 25 bp, E. coli
tctgaactgattctggatatcgaca

SEQ ID NO: 221842 - DNA, 25 bp, E. coli
tctgaactgattgtggatatcgaca

SEQ ID NO: 221843 - DNA, 25 bp, E. coli
cctaaatcgattcccagaattgaaa

SEQ ID NO: 221844 - DNA, 25 bp, E. coli
cctaaatcgattgccagaattgaaa

SEQ ID NO: 221845 - DNA, 25 bp, E. coli
gaaacaggtcgttttgattgcggcc

SEQ ID NO: 221846 - DNA, 25 bp, E. coli
gaaacaggtcgtattgattgcggcc

SEQ ID NO: 221847 - DNA, 25 bp, E. coli
tggtatacgctgcactgagtcgtga

SEQ ID NO: 221848 - DNA, 25 bp, E. coli
ggcaggttcctgtgaaaagatatta

SEQ ID NO: 221849 - DNA, 25 bp, E. coli
ggcaggttcctgagaaaagatatta

SEQ ID NO: 221850 - DNA, 25 bp, E. coli
tggtatacgctggactgagtcgtga

SEQ ID NO: 221851 - DNA, 25 bp, E. coli
tcaaaaccgttcagataaatacatc

SEQ ID NO: 221852 - DNA, 25 bp, E. coli
tcaaaaccgttctgataaatacatc

SEQ ID NO: 221853 - DNA, 25 bp, E. coli
aatgccctgatggataccacgtaag

SEQ ID NO: 221854 - DNA, 25 bp, E. coli
aatgccctgatgcataccacgtaag

SEQ ID NO: 221855 - DNA, 25 bp, E. coli
cacgtaagccagcattttcgcaagg

SEQ ID NO: 221856 - DNA, 25 bp, E. coli
cacgtaagccaggattttcgcaagg

SEQ ID NO: 221857 - DNA, 25 bp, E. coli
caggaatttatgacgggtgccttgt

SEQ ID NO: 221858 - DNA, 25 bp, E. coli
caggaatttatgtcgggtgccttgt

SEQ ID NO: 221859 - DNA, 25 bp, E. coli
cttgttaaggtcataagaaggaggc

SEQ ID NO: 221860 - DNA, 25 bp, E. coli
cttgttaaggtcttaagaaggaggc

SEQ ID NO: 221861 - DNA, 25 bp, E. coli
tagcgaaaattgattgtgccatcca

SEQ ID NO: 221862 - DNA, 25 bp, E. coli
tagcgaaaattgtttgtgccatcca

SEQ ID NO: 221863 - DNA, 25 bp, E. coli
tttcgcaagggaagatgatgatgac

SEQ ID NO: 221864 - DNA, 25 bp, E. coli
tttcgcaagggatgatgatgatgac

SEQ ID NO: 221865 - DNA, 25 bp, E. coli
tgtgccatccaaagattatctatgg

SEQ ID NO: 221866 - DNA, 25 bp, E. coli
tgtgccatccaatgattatctatgg

SEQ ID NO: 221867 - DNA, 25 bp, E. coli
tgatgacgaaactcccgacaggaat

SEQ ID NO: 221868 - DNA, 25 bp, E. coli
tgatgacgaaacacccgacaggaat

SEQ ID NO: 221869 - DNA, 25 bp, E. coli
tctatggcaatgatttactgatgaa

SEQ ID NO: 221870 - DNA, 25 bp, E. coli
tctatggcaatgttttactgatgaa

SEQ ID NO: 221871 - DNA, 25 bp, E. coli
ctaagaatggagttaaaagagagcg

SEQ ID NO: 221872 - DNA, 25 bp, E. coli
ctaagaatggagataaaagagagcg

SEQ ID NO: 221873 - DNA, 25 bp, E. coli
taatcaaggatattgctaatgccct

SEQ ID NO: 221874 - DNA, 25 bp, E. coli
taatcaaggataatgctaatgccct

SEQ ID NO: 221875 - DNA, 25 bp, E. coli
tacattattacgagtatagctacgc

SEQ ID NO: 221876 - DNA, 25 bp, E. coli
tacattattacgtgtatagctacgc

SEQ ID NO: 221877 - DNA, 25 bp, E. coli
taaaagcgcagctaacgagaaagcg

SEQ ID NO: 221878 - DNA, 25 bp, E. coli
taaacaggccgcttgagggaaataa

SEQ ID NO: 221879 - DNA, 25 bp, E. coli
taaacaggccgcatgagggaaataa

SEQ ID NO: 221880 - DNA, 25 bp, E. coli
taaaagcgcagcaaacgagaaagcg

SEQ ID NO: 221881 - DNA, 25 bp, E. coli
cttttaatcactttgcgtcgggaag

SEQ ID NO: 221882 - DNA, 25 bp, E. coli
cttttaatcactatgcgtcgggaag

SEQ ID NO: 221883 - DNA, 25 bp, E. coli
gcttgagggaaaaaagacgatgccg

SEQ ID NO: 221884 - DNA, 25 bp, E. coli
gcgaattttgtagctgaaaccacgg

SEQ ID NO: 221885 - DNA, 25 bp, E. coli
gcttgagggaaataagacgatgccg

SEQ ID NO: 221886 - DNA, 25 bp, E. coli
gcgaattttgtacctgaaaccacgg

SEQ ID NO: 221887 - DNA, 25 bp, E. coli
gaaaccacggtttagcacattctta

SEQ ID NO: 221888 - DNA, 25 bp, E. coli
gacgatgccgctttacccagtttaa

SEQ ID NO: 221889 - DNA, 25 bp, E. coli
gaaaccacggttaagcacattctta

SEQ ID NO: 221890 - DNA, 25 bp, E. coli
gacgatgccgctatacccagtttaa

SEQ ID NO: 221891 - DNA, 25 bp, E. coli
gttacaatcacccaccgtaaacagg

SEQ ID NO: 221892 - DNA, 25 bp, E. coli
gttacaatcaccgaccgtaaacagg

SEQ ID NO: 221893 - DNA, 25 bp, E. coli
tcaacgacttgcgtgtattggctcc

SEQ ID NO: 221894 - DNA, 25 bp, E. coli
taatcgcgcagactttaataaaagc

SEQ ID NO: 221895 - DNA, 25 bp, E. coli
tcaacgacttgcctgtattggctcc

SEQ ID NO: 221896 - DNA, 25 bp, E. coli
taatcgcgcagagtttaataaaagc

SEQ ID NO: 221897 - DNA, 25 bp, E. coli
aatacgcgattgatgttgagcatca

SEQ ID NO: 221898 - DNA, 25 bp, E. coli
aatacgcgattgttgttgagcatca

SEQ ID NO: 221899 - DNA, 25 bp, E. coli
atggcgaaccggaatgtgttaagga

SEQ ID NO: 221900 - DNA, 25 bp, E. coli
atggcgaaccggtatgtgttaagga

SEQ ID NO: 221901 - DNA, 25 bp, E. coli
tattgacgtgataggtaacgtgtac

SEQ ID NO: 221902 - DNA, 25 bp, E. coli
tattgacgtgattggtaacgtgtac

SEQ ID NO: 221903 - DNA, 25 bp, E. coli
tattggctattatgatgacgagtcg

SEQ ID NO: 221904 - DNA, 25 bp, E. coli
tattggctattaagatgacgagtcg

SEQ ID NO: 221905 - DNA, 25 bp, E. coli
tgacgagtcgatccagggtgatatt

SEQ ID NO: 221906 - DNA, 25 bp, E. coli
tgacgagtcgatgcagggtgatatt

SEQ ID NO: 221907 - DNA, 25 bp, E. coli
gcatcaacttcgaggctggatgtga

SEQ ID NO: 221908 - DNA, 25 bp, E. coli
gctcaaatttgcagacagggccgac

SEQ ID NO: 221909 - DNA, 25 bp, E. coli
gctcaaatttgctgacagggccgac

SEQ ID NO: 221910 - DNA, 25 bp, E. coli
gcatcaacttcgtggctggatgtga

SEQ ID NO: 221911 - DNA, 25 bp, E. coli
gacggatattttctaaacgtgcgca

SEQ ID NO: 221912 - DNA, 25 bp, E. coli
gaactgactgaacatggcgaaccgg

SEQ ID NO: 221913 - DNA, 25 bp, E. coli
gacttttcggccattatggagagta

SEQ ID NO: 221914 - DNA, 25 bp, E. coli
gacggatattttgtaaacgtgcgca

SEQ ID NO: 221915 - DNA, 25 bp, E. coli
gaactgactgaagatggcgaaccgg

SEQ ID NO: 221916 - DNA, 25 bp, E. coli
gacttttcggcctttatggagagta

SEQ ID NO: 221917 - DNA, 25 bp, E. coli
cgtgtacaaagataccggagaactg

SEQ ID NO: 221918 - DNA, 25 bp, E. coli
cgtgtacaaagaaaccggagaactg

SEQ ID NO: 221919 - DNA, 25 bp, E. coli
cataaagcaaggctgtatgagcgag

SEQ ID NO: 221920 - DNA, 25 bp, E. coli
cataaagcaagggtgtatgagcgag

SEQ ID NO: 221921 - DNA, 25 bp, E. coli
atacctaactttaccagcaacacct

SEQ ID NO: 221922 - DNA, 25 bp, E. coli
atacctaacttttccagcaacacct

SEQ ID NO: 221923 - DNA, 25 bp, E. coli
ttttggcgctccaaatatatggctg

SEQ ID NO: 221924 - DNA, 25 bp, E. coli
ttttggcgctcctaatatatggctg

SEQ ID NO: 221925 - DNA, 25 bp, E. coli
gcgctcctaatatatggctgattta

SEQ ID NO: 221926 - DNA, 25 bp, E. coli
gcgctcctaataaatggctgattta

SEQ ID NO: 221927 - DNA, 25 bp, E. coli
gcaaggctgtatgagcgagaaatta

SEQ ID NO: 221928 - DNA, 25 bp, E. coli
gcaaggctgtatcagcgagaaatta

SEQ ID NO: 221929 - DNA, 25 bp, E. coli
gactcactcattcatccaataccta

SEQ ID NO: 221930 - DNA, 25 bp, E. coli
gactcactcattgatccaataccta

SEQ ID NO: 221931 - DNA, 25 bp, E. coli
cgtccccagtaggactggctgctgg

SEQ ID NO: 221932 - DNA, 25 bp, E. coli
cgtccccagtagcactggctgctgg

SEQ ID NO: 221933 - DNA, 25 bp, E. coli
gtttaatattatcttgactcactca

SEQ ID NO: 221934 - DNA, 25 bp, E. coli
gtttaatattatgttgactcactca

SEQ ID NO: 221935 - DNA, 25 bp, E. coli
ggtgcgttttattcataaagcaagg

SEQ ID NO: 221936 - DNA, 25 bp, E. coli
ggtgcgttttatacataaagcaagg

SEQ ID NO: 221937 - DNA, 25 bp, E. coli
ggctgatttataattgtgagtttaa

SEQ ID NO: 221938 - DNA, 25 bp, E. coli
ggctgatttatatttgtgagtttaa

SEQ ID NO: 221939 - DNA, 25 bp, E. coli
gatccaatacctaactttaccagca

SEQ ID NO: 221940 - DNA, 25 bp, E. coli
gatccaataccttactttaccagca

SEQ ID NO: 221941 - DNA, 25 bp, E. coli
cagaagatccgaccccgctggtgtg

SEQ ID NO: 221942 - DNA, 25 bp, E. coli
cagaagatccgagcccgctggtgtg

SEQ ID NO: 221943 - DNA, 25 bp, E. coli
atccgaccccgcaggtgtgccatgg

SEQ ID NO: 221944 - DNA, 25 bp, E. coli
atccgaccccgctggtgtgccatgg

SEQ ID NO: 221945 - DNA, 25 bp, E. coli
tgtgattactcgcgaaccggcgggc

SEQ ID NO: 221946 - DNA, 25 bp, E. coli
tgtgattactcgggaaccggcgggc

SEQ ID NO: 221947 - DNA, 25 bp, E. coli
ccgggtgtgatttctcgcgaaccgg

SEQ ID NO: 221948 - DNA, 25 bp, E. coli
gccgggtgtgataactcgcgaaccg

SEQ ID NO: 221949 - DNA, 25 bp, E. coli
gccgggtgtgattactcgcgaaccg

SEQ ID NO: 221950 - DNA, 25 bp, E. coli
gcagaagatccgaccccgctggtgt

SEQ ID NO: 221951 - DNA, 25 bp, E. coli
gcagaagatccgtccccgctggtgt

SEQ ID NO: 221952 - DNA, 25 bp, E. coli
cgaccccgctggtgtgccatggcag

SEQ ID NO: 221953 - DNA, 25 bp, E. coli
cgaccccgctggagtgccatggcag

SEQ ID NO: 221954 - DNA, 25 bp, E. coli
ccgggtgtgattactcgcgaaccgg

SEQ ID NO: 221955 - DNA, 25 bp, E. coli
ctgcgtcacgcagaagatccgaccc

SEQ ID NO: 221956 - DNA, 25 bp, E. coli
ctgcgtcacgcacaagatccgaccc

SEQ ID NO: 221957 - DNA, 25 bp, E. coli
ggtgtgattactggcgaaccggcgg

SEQ ID NO: 221958 - DNA, 25 bp, E. coli
ggtgtgattactcgcgaaccggcgg

SEQ ID NO: 221959 - DNA, 25 bp, E. coli
gaccccgctggtgtgccatggcagc

SEQ ID NO: 221960 - DNA, 25 bp, E. coli
gaccccgctggtctgccatggcagc

SEQ ID NO: 221961 - DNA, 25 bp, E. coli
gatccgaccccgctggtgtgccatg

SEQ ID NO: 221962 - DNA, 25 bp, E. coli
gatccgaccccggtggtgtgccatg

SEQ ID NO: 221963 - DNA, 25 bp, E. coli
caattacggatgaaatggcagcgca

SEQ ID NO: 221964 - DNA, 25 bp, E. coli
caattacggatgtaatggcagcgca

SEQ ID NO: 221965 - DNA, 25 bp, E. coli
caaaagttggtgatcaggaccctca

SEQ ID NO: 221966 - DNA, 25 bp, E. coli
caaaagttggtgttcaggaccctca

SEQ ID NO: 221967 - DNA, 25 bp, E. coli
ccagcgacaggcaccggttgtttaa

SEQ ID NO: 221968 - DNA, 25 bp, E. coli
ccagcgacaggctccggttgtttaa

SEQ ID NO: 221969 - DNA, 25 bp, E. coli
tatgcggacgtcattggtaaactgg

SEQ ID NO: 221970 - DNA, 25 bp, E. coli
tatgcggacgtctttggtaaactgg

SEQ ID NO: 221971 - DNA, 25 bp, E. coli
tctccaaaattgtgcgatgacgctc

SEQ ID NO: 221972 - DNA, 25 bp, E. coli
tctccaaaattgagcgatgacgctc

SEQ ID NO: 221973 - DNA, 25 bp, E. coli
gaagtggtgaaacactacagacgcg

SEQ ID NO: 221974 - DNA, 25 bp, E. coli
gaagcatacgcggaagcgcaattga

SEQ ID NO: 221975 - DNA, 25 bp, E. coli
gaagtggtgaaagactacagacgcg

SEQ ID NO: 221976 - DNA, 25 bp, E. coli
gaagcatacgcgcaagcgcaattga

SEQ ID NO: 221977 - DNA, 25 bp, E. coli
cgcaattgaggaaggtgacgagata

SEQ ID NO: 221978 - DNA, 25 bp, E. coli
cgcaattgaggatggtgacgagata

SEQ ID NO: 221979 - DNA, 25 bp, E. coli
cattgccatggtaagggcgaagcca

SEQ ID NO: 221980 - DNA, 25 bp, E. coli
cattgccatggttagggcgaagcca

SEQ ID NO: 221981 - DNA, 25 bp, E. coli
gtttagtcgtttaccgaccacgctg

SEQ ID NO: 221982 - DNA, 25 bp, E. coli
gtttagtcgttttccgaccacgctg

SEQ ID NO: 221983 - DNA, 25 bp, E. coli
tacagattattcgttacctcgtgag

SEQ ID NO: 221984 - DNA, 25 bp, E. coli
tacagattattccttacctcgtgag

SEQ ID NO: 221985 - DNA, 25 bp, E. coli
cacactacgcctcaacgttgaaaat

SEQ ID NO: 221986 - DNA, 25 bp, E. coli
cacactacgcctgaacgttgaaaat

SEQ ID NO: 221987 - DNA, 25 bp, E. coli
cacggtgagatgctcatcaatgtgg

SEQ ID NO: 221988 - DNA, 25 bp, E. coli
cacggtgagatggtcatcaatgtgg

SEQ ID NO: 221989 - DNA, 25 bp, E. coli
catcaatgtggatgttgcggtggca

SEQ ID NO: 221990 - DNA, 25 bp, E. coli
catcaatgtggaagttgcggtggca

SEQ ID NO: 221991 - DNA, 25 bp, E. coli
agtgcctctggatgttggcccgcaa

SEQ ID NO: 221992 - DNA, 25 bp, E. coli
agtgcctctggaagttggcccgcaa

SEQ ID NO: 221993 - DNA, 25 bp, E. coli
tacgcctgaacgatgaaaatccgga

SEQ ID NO: 221994 - DNA, 25 bp, E. coli
tacgcctgaacgttgaaaatccgga

SEQ ID NO: 221995 - DNA, 25 bp, E. coli
tgggcacggtgacatggtcatcaat

SEQ ID NO: 221996 - DNA, 25 bp, E. coli
tgttgcggtggctagcgatacaccg

SEQ ID NO: 221997 - DNA, 25 bp, E. coli
tgttgcggtggcaagcgatacaccg

SEQ ID NO: 221998 - DNA, 25 bp, E. coli
tgggcacggtgagatggtcatcaat

SEQ ID NO: 221999 - DNA, 25 bp, E. coli
tgttggcccgcatggtaagcagttg

SEQ ID NO: 222000 - DNA, 25 bp, E. coli
tgttggcccgcaaggtaagcagttg

SEQ ID NO: 222001 - DNA, 25 bp, E. coli
tgaaaatccggatctgtggagcgcc

SEQ ID NO: 222002 - DNA, 25 bp, E. coli
tgaaaatccggaactgtggagcgcc

SEQ ID NO: 222003 - DNA, 25 bp, E. coli
gcccgcaaggtatgcagttgattga

SEQ ID NO: 222004 - DNA, 25 bp, E. coli
gcccgcaaggtaagcagttgattga

SEQ ID NO: 222005 - DNA, 25 bp, E. coli
cgcggtgctgataacaaccgcccac

SEQ ID NO: 222006 - DNA, 25 bp, E. coli
cgcggtgctgattacaaccgcccac

SEQ ID NO: 222007 - DNA, 25 bp, E. coli
cacatggtcgctgcctggcgctgtg

SEQ ID NO: 222008 - DNA, 25 bp, E. coli
cacatggtcgctccctggcgctgtg

SEQ ID NO: 222009 - DNA, 25 bp, E. coli
attgttttcactgtggcgacggttg

SEQ ID NO: 222010 - DNA, 25 bp, E. coli
attgttttcactctggcgacggttg

SEQ ID NO: 222011 - DNA, 25 bp, E. coli
tttatcgtggctgtgcgcgttggca

SEQ ID NO: 222012 - DNA, 25 bp, E. coli
tttatcgtggctctgcgcgttggca

SEQ ID NO: 222013 - DNA, 25 bp, E. coli
tgaggttgaagagaccacatggtcg

SEQ ID NO: 222014 - DNA, 25 bp, E. coli
tgaggttgaagacaccacatggtcg

SEQ ID NO: 222015 - DNA, 25 bp, E. coli
tgcgtaacagcctcaacattacatt

SEQ ID NO: 222016 - DNA, 25 bp, E. coli
tgcgtaacagccacaacattacatt

SEQ ID NO: 222017 - DNA, 25 bp, E. coli
tcactctggcgacggttggcattat

SEQ ID NO: 222018 - DNA, 25 bp, E. coli
tcactctggcgagggttggcattat

SEQ ID NO: 222019 - DNA, 25 bp, E. coli
gcctggcgctgtcgttggtttttta

SEQ ID NO: 222020 - DNA, 25 bp, E. coli
gcctggcgctgtggttggtttttta

SEQ ID NO: 222021 - DNA, 25 bp, E. coli
cgcgttggcaataccgatgttgatt

SEQ ID NO: 222022 - DNA, 25 bp, E. coli
cgcgttggcaattccgatgttgatt

SEQ ID NO: 222023 - DNA, 25 bp, E. coli
cggttggcattaagtttggtgcact

SEQ ID NO: 222024 - DNA, 25 bp, E. coli
cggttggcattatgtttggtgcact

SEQ ID NO: 222025 - DNA, 25 bp, E. coli
ggctgtgcgcgttggcaattccgat

SEQ ID NO: 222026 - DNA, 25 bp, E. coli
ggctgtgcgcgtaggcaattccgat

SEQ ID NO: 222027 - DNA, 25 bp, E. coli
tggttttttatcctggctgtgcgcg

SEQ ID NO: 222028 - DNA, 25 bp, E. coli
tggttttttatcgtggctgtgcgcg

SEQ ID NO: 222029 - DNA, 25 bp, E. coli
cactggattgcgtttgtgctgctga

SEQ ID NO: 222030 - DNA, 25 bp, E. coli
cactggattgcgattgtgctgctga

SEQ ID NO: 222031 - DNA, 25 bp, E. coli
tatcgcgaccgctttggccattggt

SEQ ID NO: 222032 - DNA, 25 bp, E. coli
tatcgcgaccgcattggccattggt

SEQ ID NO: 222033 - DNA, 25 bp, E. coli
ttttggtgccgtggaaaccctgacg

SEQ ID NO: 222034 - DNA, 25 bp, E. coli
ttttctgaagcattgcgaaccggcc

SEQ ID NO: 222035 - DNA, 25 bp, E. coli
ttttggtgccgtcgaaaccctgacg

SEQ ID NO: 222036 - DNA, 25 bp, E. coli
ttttctgaagcaatgcgaaccggcc

SEQ ID NO: 222037 - DNA, 25 bp, E. coli
ccagccggtttgaccttgaatggaa

SEQ ID NO: 222038 - DNA, 25 bp, E. coli
ccagccggtttgtccttgaatggaa

SEQ ID NO: 222039 - DNA, 25 bp, E. coli
gcatcaatcggtaaaggtgccaccc

SEQ ID NO: 222040 - DNA, 25 bp, E. coli
gaatgggcatgttagccagccggtt

SEQ ID NO: 222041 - DNA, 25 bp, E. coli
gaatgggcatgtaagccagccggtt

SEQ ID NO: 222042 - DNA, 25 bp, E. coli
gcatcaatcggttaaggtgccaccc

SEQ ID NO: 222043 - DNA, 25 bp, E. coli
gattattgagggttttcgtggcgca

SEQ ID NO: 222044 - DNA, 25 bp, E. coli
gattattgagggatttcgtggcgca

SEQ ID NO: 222045 - DNA, 25 bp, E. coli
gtgttttatggaaaccccggtcagg

SEQ ID NO: 222046 - DNA, 25 bp, E. coli
gtgttttatggataccccggtcagg

SEQ ID NO: 222047 - DNA, 25 bp, E. coli
ggtgccaccctccataaaccgaaat

SEQ ID NO: 222048 - DNA, 25 bp, E. coli
ggtgccaccctcgataaaccgaaat

SEQ ID NO: 222049 - DNA, 25 bp, E. coli
gatggttggtcgctttatcggctca

SEQ ID NO: 222050 - DNA, 25 bp, E. coli
gatggttggtcggtttatcggctca

SEQ ID NO: 222051 - DNA, 25 bp, E. coli
caaactgttagctggcagcttaagc

SEQ ID NO: 222052 - DNA, 25 bp, E. coli
caaactgttagcaggcagcttaagc

SEQ ID NO: 222053 - DNA, 25 bp, E. coli
agacggaactgctggcaatgggccc

SEQ ID NO: 222054 - DNA, 25 bp, E. coli
agacggaactgcaggcaatgggccc

SEQ ID NO: 222055 - DNA, 25 bp, E. coli
tgtcagtaataatgcggcgtggaac

SEQ ID NO: 222056 - DNA, 25 bp, E. coli
tgtcagtaataaagcggcgtggaac

SEQ ID NO: 222057 - DNA, 25 bp, E. coli
tctgttcgcgtgtaaaacggatgct

SEQ ID NO: 222058 - DNA, 25 bp, E. coli
tctgttcgcgtgaaaaacggatgct

SEQ ID NO: 222059 - DNA, 25 bp, E. coli
gaaaccttccactgaatggtggcga

SEQ ID NO: 222060 - DNA, 25 bp, E. coli
gaaaccttccacagaatggtggcga

SEQ ID NO: 222061 - DNA, 25 bp, E. coli
cgatgccgcgatcgtcggttacagc

SEQ ID NO: 222062 - DNA, 25 bp, E. coli
cgatgccgcgatggtcggttacagc

SEQ ID NO: 222063 - DNA, 25 bp, E. coli
gattaccggcttactgtggatgccc

SEQ ID NO: 222064 - DNA, 25 bp, E. coli
gttggactgatcgtcgaacccgtgc

SEQ ID NO: 222065 - DNA, 25 bp, E. coli
gttggactgatcctcgaacccgtgc

SEQ ID NO: 222066 - DNA, 25 bp, E. coli
gattaccggctttctgtggatgccc

SEQ ID NO: 222067 - DNA, 25 bp, E. coli
gggagcattcttacaccatacgcca

SEQ ID NO: 222068 - DNA, 25 bp, E. coli
gggagcattctttcaccatacgcca

SEQ ID NO: 222069 - DNA, 25 bp, E. coli
ggttcctcgggaagttgccgctcag

SEQ ID NO: 222070 - DNA, 25 bp, E. coli
ggttcctcgggatgttgccgctcag

SEQ ID NO: 222071 - DNA, 25 bp, E. coli
ggttccctggctggcttacgtgctg

SEQ ID NO: 222072 - DNA, 25 bp, E. coli
ggttccctggctcgcttacgtgctg

SEQ ID NO: 222073 - DNA, 25 bp, E. coli
cataaaacagaacagaaggtaaggt

SEQ ID NO: 222074 - DNA, 25 bp, E. coli
cataaaacagaagagaaggtaaggt

SEQ ID NO: 222075 - DNA, 25 bp, E. coli
taaatcagcgattttgcgcaacaaa

SEQ ID NO: 222076 - DNA, 25 bp, E. coli
taaatcagcgatattgcgcaacaaa

SEQ ID NO: 222077 - DNA, 25 bp, E. coli
ctaataaccaaatcgactaacctgt

SEQ ID NO: 222078 - DNA, 25 bp, E. coli
ctaataaccaaaacgactaacctgt

SEQ ID NO: 222079 - DNA, 25 bp, E. coli
tgtcagcgcccaaaaaacagaagag

SEQ ID NO: 222080 - DNA, 25 bp, E. coli
tgtggattaaagacgggatagcgat

SEQ ID NO: 222081 - DNA, 25 bp, E. coli
tgtggattaaagtcgggatagcgat

SEQ ID NO: 222082 - DNA, 25 bp, E. coli
tgtcagcgcccataaaacagaagag

SEQ ID NO: 222083 - DNA, 25 bp, E. coli
tcgactaacctgttttagcaatagt

SEQ ID NO: 222084 - DNA, 25 bp, E. coli
tcgactaacctgatttagcaatagt

SEQ ID NO: 222085 - DNA, 25 bp, E. coli
gccaatcattaagataaatcagcga

SEQ ID NO: 222086 - DNA, 25 bp, E. coli
gccaatcattaacataaatcagcga

SEQ ID NO: 222087 - DNA, 25 bp, E. coli
gcgtcgttatgttccagtaagcaaa

SEQ ID NO: 222088 - DNA, 25 bp, E. coli
gcgtcgttatgtaccagtaagcaaa

SEQ ID NO: 222089 - DNA, 25 bp, E. coli
gacgggatagcgataactaataacc

SEQ ID NO: 222090 - DNA, 25 bp, E. coli
taaccaacctaaagaaaaacaaatg

SEQ ID NO: 222091 - DNA, 25 bp, E. coli
taaccaacctaatgaaaaacaaatg

SEQ ID NO: 222092 - DNA, 25 bp, E. coli
taagcaaagctgattctgcgccctg

SEQ ID NO: 222093 - DNA, 25 bp, E. coli
taagcaaagctgtttctgcgccctg

SEQ ID NO: 222094 - DNA, 25 bp, E. coli
gacgggatagcgttaactaataacc

SEQ ID NO: 222095 - DNA, 25 bp, E. coli
tacagcaacatggaccggaatgcgg

SEQ ID NO: 222096 - DNA, 25 bp, E. coli
tacagcaacatgcaccggaatgcgg

SEQ ID NO: 222097 - DNA, 25 bp, E. coli
tatgccgttctttccaatgctgccg

SEQ ID NO: 222098 - DNA, 25 bp, E. coli
tacgcgcaatggaagaaggtatccc

SEQ ID NO: 222099 - DNA, 25 bp, E. coli
tatcctcgtataaggtggcacgcaa

SEQ ID NO: 222100 - DNA, 25 bp, E. coli
tatgccgttcttaccaatgctgccg

SEQ ID NO: 222101 - DNA, 25 bp, E. coli
tatcctcgtatatggtggcacgcaa

SEQ ID NO: 222102 - DNA, 25 bp, E. coli
tacgcgcaatggtagaaggtatccc

SEQ ID NO: 222103 - DNA, 25 bp, E. coli
tattgcatcgacaggaacatcagcc

SEQ ID NO: 222104 - DNA, 25 bp, E. coli
tattgcatcgactggaacatcagcc

SEQ ID NO: 222105 - DNA, 25 bp, E. coli
tcctgatgggccgaaagcaaattac

SEQ ID NO: 222106 - DNA, 25 bp, E. coli
tcctgatgggcccaaagcaaattac

SEQ ID NO: 222107 - DNA, 25 bp, E. coli
gacagcggcatccaaatccagagga

SEQ ID NO: 222108 - DNA, 25 bp, E. coli
gacagcggcatcgaaatccagagga

SEQ ID NO: 222109 - DNA, 25 bp, E. coli
cattacaggcaactctagggctgga

SEQ ID NO: 222110 - DNA, 25 bp, E. coli
cattacaggcaagtctagggctgga

SEQ ID NO: 222111 - DNA, 25 bp, E. coli
gataaaggtctgctctcagggctag

SEQ ID NO: 222112 - DNA, 25 bp, E. coli
gatattgaacatgccacaggtgctg

SEQ ID NO: 222113 - DNA, 25 bp, E. coli
gataaaggtctggtctcagggctag

SEQ ID NO: 222114 - DNA, 25 bp, E. coli
gatattgaacatcccacaggtgctg

SEQ ID NO: 222115 - DNA, 25 bp, E. coli
tcagaccgggagaagcagattttaa

SEQ ID NO: 222116 - DNA, 25 bp, E. coli
tcagaccgggagtagcagattttaa

SEQ ID NO: 222117 - DNA, 25 bp, E. coli
aatggtggatatactctaccgtggt

SEQ ID NO: 222118 - DNA, 25 bp, E. coli
aatggtggatattctctaccgtggt

SEQ ID NO: 222119 - DNA, 25 bp, E. coli
caaatgcttggacaagggatcgccg

SEQ ID NO: 222120 - DNA, 25 bp, E. coli
caaatgcttggagaagggatcgccg

SEQ ID NO: 222121 - DNA, 25 bp, E. coli
taaagcaccagtacgcacaatggtg

SEQ ID NO: 222122 - DNA, 25 bp, E. coli
taaagcaccagttcgcacaatggtg

SEQ ID NO: 222123 - DNA, 25 bp, E. coli
actggccccaatgatcggcgcgttg

SEQ ID NO: 222124 - DNA, 25 bp, E. coli
actggccccaatcatcggcgcgttg

SEQ ID NO: 222125 - DNA, 25 bp, E. coli
ccagcaaatgcttggacaagggatc

SEQ ID NO: 222126 - DNA, 25 bp, E. coli
ccagcaaatgctaggacaagggatc

SEQ ID NO: 222127 - DNA, 25 bp, E. coli
gcaccagtacgctcaatggtggata

SEQ ID NO: 222128 - DNA, 25 bp, E. coli
gcaccagtacgcacaatggtggata

SEQ ID NO: 222129 - DNA, 25 bp, E. coli
gcaggtaaagcagcagtacgcacaa

SEQ ID NO: 222130 - DNA, 25 bp, E. coli
gcaggtaaagcaccagtacgcacaa

SEQ ID NO: 222131 - DNA, 25 bp, E. coli
cttggacaagggatcgccgggatct

SEQ ID NO: 222132 - DNA, 25 bp, E. coli
cttggacaagggttcgccgggatct

SEQ ID NO: 222133 - DNA, 25 bp, E. coli
tggcatcgctctcgttcagtctgac

SEQ ID NO: 222134 - DNA, 25 bp, E. coli
ggccccaatcatcggcgcgttgatc

SEQ ID NO: 222135 - DNA, 25 bp, E. coli
tggcatcgctctggttcagtctgac

SEQ ID NO: 222136 - DNA, 25 bp, E. coli
ggccccaatcatgggcgcgttgatc

SEQ ID NO: 222137 - DNA, 25 bp, E. coli
gagaaacacgcaggtaaagcaccag

SEQ ID NO: 222138 - DNA, 25 bp, E. coli
gagaaacacgcacgtaaagcaccag

SEQ ID NO: 222139 - DNA, 25 bp, E. coli
tagcctccgccgtttatgcactttt

SEQ ID NO: 222140 - DNA, 25 bp, E. coli
tagcctccgccgattatgcactttt

SEQ ID NO: 222141 - DNA, 25 bp, E. coli
tttcgtcaatgatcacaattccaga

SEQ ID NO: 222142 - DNA, 25 bp, E. coli
tttcgtcaatgaacacaattccaga

SEQ ID NO: 222143 - DNA, 25 bp, E. coli
tttattcacccagatcgcaaacgta

SEQ ID NO: 222144 - DNA, 25 bp, E. coli
tttattcacccacatcgcaaacgta

SEQ ID NO: 222145 - DNA, 25 bp, E. coli
tccttgatttcctgttagcctccgc

SEQ ID NO: 222146 - DNA, 25 bp, E. coli
tccttgatttccagttagcctccgc

SEQ ID NO: 222147 - DNA, 25 bp, E. coli
gcacttttatcactggctggcacga

SEQ ID NO: 222148 - DNA, 25 bp, E. coli
gcaatctacatttacagcgcaaaca

SEQ ID NO: 222149 - DNA, 25 bp, E. coli
gcaaacgtattcactttatatgcac

SEQ ID NO: 222150 - DNA, 25 bp, E. coli
gcaatctacattaacagcgcaaaca

SEQ ID NO: 222151 - DNA, 25 bp, E. coli
gcaaacgtattctctttatatgcac

SEQ ID NO: 222152 - DNA, 25 bp, E. coli
gcacttttatcagtggctggcacga

SEQ ID NO: 222153 - DNA, 25 bp, E. coli
cgaattatttacagtagaggtcgct

SEQ ID NO: 222154 - DNA, 25 bp, E. coli
cgaattatttactgtagaggtcgct

SEQ ID NO: 222155 - DNA, 25 bp, E. coli
tgcatatggtttggttataactcct

SEQ ID NO: 222156 - DNA, 25 bp, E. coli
gtcgctgccatttattcagataaag

SEQ ID NO: 222157 - DNA, 25 bp, E. coli
gtcgctgccattaattcagataaag

SEQ ID NO: 222158 - DNA, 25 bp, E. coli
tggctggcacgatccctgcaatcta

SEQ ID NO: 222159 - DNA, 25 bp, E. coli
tggctggcacgaaccctgcaatcta

SEQ ID NO: 222160 - DNA, 25 bp, E. coli
tgcatatggtttcgttataactcct

SEQ ID NO: 222161 - DNA, 25 bp, E. coli
attggtattagcgtgatcctggcag

SEQ ID NO: 222162 - DNA, 25 bp, E. coli
attagcgtgatcgtggcagtgatga

SEQ ID NO: 222163 - DNA, 25 bp, E. coli
attagcgtgatcctggcagtgatga

SEQ ID NO: 222164 - DNA, 25 bp, E. coli
attggtattagcctgatcctggcag

SEQ ID NO: 222165 - DNA, 25 bp, E. coli
ttggtattagcgtgatcctggcagt

SEQ ID NO: 222166 - DNA, 25 bp, E. coli
tagcgtgatcctcgcagtgatgatg

SEQ ID NO: 222167 - DNA, 25 bp, E. coli
tagcgtgatcctggcagtgatgatg

SEQ ID NO: 222168 - DNA, 25 bp, E. coli
ttggtattagcgagatcctggcagt

SEQ ID NO: 222169 - DNA, 25 bp, E. coli
tattagcgtgatgctggcagtgatg

SEQ ID NO: 222170 - DNA, 25 bp, E. coli
tattagcgtgatcctggcagtgatg

SEQ ID NO: 222171 - DNA, 25 bp, E. coli
ttagcgtgatcctggcagtgatgat

SEQ ID NO: 222172 - DNA, 25 bp, E. coli
ttagcgtgatccaggcagtgatgat

SEQ ID NO: 222173 - DNA, 25 bp, E. coli
tggtattagcgtcatcctggcagtg

SEQ ID NO: 222174 - DNA, 25 bp, E. coli
tgatcctggcagtgatgatgtatcg

SEQ ID NO: 222175 - DNA, 25 bp, E. coli
tgatcctggcagagatgatgtatcg

SEQ ID NO: 222176 - DNA, 25 bp, E. coli
cgtgatcctggcagtgatgatgtat

SEQ ID NO: 222177 - DNA, 25 bp, E. coli
cgtgatcctggctgtgatgatgtat

SEQ ID NO: 222178 - DNA, 25 bp, E. coli
gatcctggcagtcatgatgtatcgc

SEQ ID NO: 222179 - DNA, 25 bp, E. coli
ggtattagcgtgttcctggcagtga

SEQ ID NO: 222180 - DNA, 25 bp, E. coli
ggtattagcgtgatcctggcagtga

SEQ ID NO: 222181 - DNA, 25 bp, E. coli
tggtattagcgtgatcctggcagtg

SEQ ID NO: 222182 - DNA, 25 bp, E. coli
gatcctggcagtgatgatgtatcgc

SEQ ID NO: 222183 - DNA, 25 bp, E. coli
aaggtatggatgttgtgatcctgct

SEQ ID NO: 222184 - DNA, 25 bp, E. coli
aaggtatggatgatgtgatcctgct

SEQ ID NO: 222185 - DNA, 25 bp, E. coli
cactatgaaggtatggatgatgtga

SEQ ID NO: 222186 - DNA, 25 bp, E. coli
cactatgaaggtttggatgatgtga

SEQ ID NO: 222187 - DNA, 25 bp, E. coli
tatgaaggtatggatgatgtgatcc

SEQ ID NO: 222188 - DNA, 25 bp, E. coli
tatgaaggtatgcatgatgtgatcc

SEQ ID NO: 222189 - DNA, 25 bp, E. coli
ttcactatgaaggtatggatgatgt

SEQ ID NO: 222190 - DNA, 25 bp, E. coli
ttcactatgaagctatggatgatgt

SEQ ID NO: 222191 - DNA, 25 bp, E. coli
tgatcctgctggttttcctgcccaa

SEQ ID NO: 222192 - DNA, 25 bp, E. coli
tgatcctgctggatttcctgcccaa

SEQ ID NO: 222193 - DNA, 25 bp, E. coli
gcattcactatgtaggtatggatga

SEQ ID NO: 222194 - DNA, 25 bp, E. coli
gcattcactatgaaggtatggatga

SEQ ID NO: 222195 - DNA, 25 bp, E. coli
gaaggtatggatcatgtgatcctgc

SEQ ID NO: 222196 - DNA, 25 bp, E. coli
gaaggtatggatgatgtgatcctgc

SEQ ID NO: 222197 - DNA, 25 bp, E. coli
cgcattcactatcaaggtatggatg

SEQ ID NO: 222198 - DNA, 25 bp, E. coli
cgcattcactatgaaggtatggatg

SEQ ID NO: 222199 - DNA, 25 bp, E. coli
cattcactatgatggtatggatgat

SEQ ID NO: 222200 - DNA, 25 bp, E. coli
ctatgaaggtatcgatgatgtgatc

SEQ ID NO: 222201 - DNA, 25 bp, E. coli
cattcactatgaaggtatggatgat

SEQ ID NO: 222202 - DNA, 25 bp, E. coli
ctatgaaggtatggatgatgtgatc

SEQ ID NO: 222203 - DNA, 25 bp, E. coli
gatcctgctggaattcctgcccaaa

SEQ ID NO: 222204 - DNA, 25 bp, E. coli
gatcctgctggatttcctgcccaaa

SEQ ID NO: 222205 - DNA, 25 bp, E. coli
cagatagagccgcttttggttttct

SEQ ID NO: 222206 - DNA, 25 bp, E. coli
cagatagagccggttttggttttct

SEQ ID NO: 222207 - DNA, 25 bp, E. coli
taaaaaatgatgaagacctgataca

SEQ ID NO: 222208 - DNA, 25 bp, E. coli
taaaaaatgatgtagacctgataca

SEQ ID NO: 222209 - DNA, 25 bp, E. coli
aaagtgcctgtgattatgccggatg

SEQ ID NO: 222210 - DNA, 25 bp, E. coli
aaagtgcctgtgtttatgccggatg

SEQ ID NO: 222211 - DNA, 25 bp, E. coli
acaacaggctattttgcgtttagca

SEQ ID NO: 222212 - DNA, 25 bp, E. coli
acaacaggctatattgcgtttagca

SEQ ID NO: 222213 - DNA, 25 bp, E. coli
tagacctgatacatagcacaacagg

SEQ ID NO: 222214 - DNA, 25 bp, E. coli
tagacctgatacttagcacaacagg

SEQ ID NO: 222215 - DNA, 25 bp, E. coli
tcagattggtgacaaagtgcctgtg

SEQ ID NO: 222216 - DNA, 25 bp, E. coli
gcgtttagcatcagtctcaaaccgg

SEQ ID NO: 222217 - DNA, 25 bp, E. coli
gcgtttagcatctgtctcaaaccgg

SEQ ID NO: 222218 - DNA, 25 bp, E. coli
gcaatcggctttttatgacgctggt

SEQ ID NO: 222219 - DNA, 25 bp, E. coli
gcaatcggctttatatgacgctggt

SEQ ID NO: 222220 - DNA, 25 bp, E. coli
gtctcaaaccggctccagatagagc

SEQ ID NO: 222221 - DNA, 25 bp, E. coli
gtctcaaaccgggtccagatagagc

SEQ ID NO: 222222 - DNA, 25 bp, E. coli
tcagattggtgagaaagtgcctgtg

SEQ ID NO: 222223 - DNA, 25 bp, E. coli
gacgctggtttcagattggtgacaa

SEQ ID NO: 222224 - DNA, 25 bp, E. coli
gatgtcttgtcgtgtagcaatcggc

SEQ ID NO: 222225 - DNA, 25 bp, E. coli
gatgtcttgtcgagtagcaatcggc

SEQ ID NO: 222226 - DNA, 25 bp, E. coli
gacgctggtttctgattggtgacaa

SEQ ID NO: 222227 - DNA, 25 bp, E. coli
caactggcgggaaagtactggcgta

SEQ ID NO: 222228 - DNA, 25 bp, E. coli
caactggcgggatagtactggcgta

SEQ ID NO: 222229 - DNA, 25 bp, E. coli
tgttaccgtgcacgacctttacgcg

SEQ ID NO: 222230 - DNA, 25 bp, E. coli
tgttaccgtgcaggacctttacgcg

SEQ ID NO: 222231 - DNA, 25 bp, E. coli
tcattatttactcggcgagacggca

SEQ ID NO: 222232 - DNA, 25 bp, E. coli
tcattatttactgggcgagacggca

SEQ ID NO: 222233 - DNA, 25 bp, E. coli
tctttatacctatagctgcccggcg

SEQ ID NO: 222234 - DNA, 25 bp, E. coli
tctttatacctaaagctgcccggcg

SEQ ID NO: 222235 - DNA, 25 bp, E. coli
gcattactgcgccagcacgaggtga

SEQ ID NO: 222236 - DNA, 25 bp, E. coli
gcattactgcgcgagcacgaggtga

SEQ ID NO: 222237 - DNA, 25 bp, E. coli
ctgcccggcgcttctgaaagagtgg

SEQ ID NO: 222238 - DNA, 25 bp, E. coli
cggaatctcaggactcggtggcaaa

SEQ ID NO: 222239 - DNA, 25 bp, E. coli
ctgcccggcgctactgaaagagtgg

SEQ ID NO: 222240 - DNA, 25 bp, E. coli
cggaatctcaggtctcggtggcaaa

SEQ ID NO: 222241 - DNA, 25 bp, E. coli
gttttgctgctgaatgcccatccgg

SEQ ID NO: 222242 - DNA, 25 bp, E. coli
gttttgctgctgtatgcccatccgg

SEQ ID NO: 222243 - DNA, 25 bp, E. coli
ggaaagtgcttaccgttatgacgcg

SEQ ID NO: 222244 - DNA, 25 bp, E. coli
tggcaaatccgcagtctccaggagg

SEQ ID NO: 222245 - DNA, 25 bp, E. coli
tggcaaatccgctgtctccaggagg

SEQ ID NO: 222246 - DNA, 25 bp, E. coli
ggaaagtgcttagcgttatgacgcg

SEQ ID NO: 222247 - DNA, 25 bp, E. coli
gatgtctcagccagcgaaagttttg

SEQ ID NO: 222248 - DNA, 25 bp, E. coli
gatgtctcagcctgcgaaagttttg

SEQ ID NO: 222249 - DNA, 25 bp, E. coli
aagaggtgttgtatccggcaatgga

SEQ ID NO: 222250 - DNA, 25 bp, E. coli
aagaggtgttgtttccggcaatgga

SEQ ID NO: 222251 - DNA, 25 bp, E. coli
cactaaccttgaaccacacgatgta

SEQ ID NO: 222252 - DNA, 25 bp, E. coli
cactaaccttgatccacacgatgta

SEQ ID NO: 222253 - DNA, 25 bp, E. coli
acagtgcgggcgaggaaccacttcg

SEQ ID NO: 222254 - DNA, 25 bp, E. coli
aaaaggcgggcgttctggcagcaat

SEQ ID NO: 222255 - DNA, 25 bp, E. coli
acagtgcgggcgtggaaccacttcg

SEQ ID NO: 222256 - DNA, 25 bp, E. coli
aaaaggcgggcgatctggcagcaat

SEQ ID NO: 222257 - DNA, 25 bp, E. coli
tttcaccagtggtggaagaggtgtt

SEQ ID NO: 222258 - DNA, 25 bp, E. coli
tttcaccagtggaggaagaggtgtt

SEQ ID NO: 222259 - DNA, 25 bp, E. coli
tgagatccaccgtctttcaccagtg

SEQ ID NO: 222260 - DNA, 25 bp, E. coli
tgagatccaccgactttcaccagtg

SEQ ID NO: 222261 - DNA, 25 bp, E. coli
tctggcagcaatgctcactaacctt

SEQ ID NO: 222262 - DNA, 25 bp, E. coli
tctggcagcaatcctcactaacctt

SEQ ID NO: 222263 - DNA, 25 bp, E. coli
gaaccacacgatgtactgtttattg

SEQ ID NO: 222264 - DNA, 25 bp, E. coli
gaaccacacgatctactgtttattg

SEQ ID NO: 222265 - DNA, 25 bp, E. coli
gcgcggtacgccacgtattgccaac

SEQ ID NO: 222266 - DNA, 25 bp, E. coli
gcgcggtacgcctcgtattgccaac

SEQ ID NO: 222267 - DNA, 25 bp, E. coli
gtcgtgcgcgcgctacgccacgtat

SEQ ID NO: 222268 - DNA, 25 bp, E. coli
gtggaaccacttcggcatcacgccg

SEQ ID NO: 222269 - DNA, 25 bp, E. coli
gtcgtgcgcgcggtacgccacgtat

SEQ ID NO: 222270 - DNA, 25 bp, E. coli
gtggaaccacttgggcatcacgccg

SEQ ID NO: 222271 - DNA, 25 bp, E. coli
cagtcggcgtcagttcattcaggca

SEQ ID NO: 222272 - DNA, 25 bp, E. coli
cagtcggcgtcacttcattcaggca

SEQ ID NO: 222273 - DNA, 25 bp, E. coli
tataacggccttgccggaatgtggc

SEQ ID NO: 222274 - DNA, 25 bp, E. coli
tataacggccttcccggaatgtggc

SEQ ID NO: 222275 - DNA, 25 bp, E. coli
ccgttcccggaagacagaggctgga

SEQ ID NO: 222276 - DNA, 25 bp, E. coli
ccgttcccggaacacagaggctgga

SEQ ID NO: 222277 - DNA, 25 bp, E. coli
aaaatgtctcaatgacggtggccgg

SEQ ID NO: 222278 - DNA, 25 bp, E. coli
aaaatgtctcaaagacggtggccgg

SEQ ID NO: 222279 - DNA, 25 bp, E. coli
aaagcccgtacgttgaagtctcgcg

SEQ ID NO: 222280 - DNA, 25 bp, E. coli
aaagcccgtacgatgaagtctcgcg

SEQ ID NO: 222281 - DNA, 25 bp, E. coli
tatgactgtacatcgtgcgcactgg

SEQ ID NO: 222282 - DNA, 25 bp, E. coli
tacgctgctggttaacggtgtacaa

SEQ ID NO: 222283 - DNA, 25 bp, E. coli
tatgactgtacaacgtgcgcactgg

SEQ ID NO: 222284 - DNA, 25 bp, E. coli
tacgctgctggtaaacggtgtacaa

SEQ ID NO: 222285 - DNA, 25 bp, E. coli
tcctgtatcggtcaagcaactttcg

SEQ ID NO: 222286 - DNA, 25 bp, E. coli
tcctgtatcggtgaagcaactttcg

SEQ ID NO: 222287 - DNA, 25 bp, E. coli
gcacggctcagctggtctataacgg

SEQ ID NO: 222288 - DNA, 25 bp, E. coli
gcacggctcagcaggtctataacgg

SEQ ID NO: 222289 - DNA, 25 bp, E. coli
gtattgatgtcaccgcgcagcaagg

SEQ ID NO: 222290 - DNA, 25 bp, E. coli
gtattgatgtcagcgcgcagcaagg

SEQ ID NO: 222291 - DNA, 25 bp, E. coli
gatgatgtcgccaaacgctgactgg

SEQ ID NO: 222292 - DNA, 25 bp, E. coli
gatgatgtcgcctaacgctgactgg

SEQ ID NO: 222293 - DNA, 25 bp, E. coli
tattgtttacccttgtcagactgcc

SEQ ID NO: 222294 - DNA, 25 bp, E. coli
tattgtttacccatgtcagactgcc

SEQ ID NO: 222295 - DNA, 25 bp, E. coli
tttttcgccaaaagcaaggtgattc

SEQ ID NO: 222296 - DNA, 25 bp, E. coli
tttttcgccaaatgcaaggtgattc

SEQ ID NO: 222297 - DNA, 25 bp, E. coli
tcctttctgcttatctcaaggcccg

SEQ ID NO: 222298 - DNA, 25 bp, E. coli
tccggcatgacatagcgcacattga

SEQ ID NO: 222299 - DNA, 25 bp, E. coli
tcctttctgcttttctcaaggcccg

SEQ ID NO: 222300 - DNA, 25 bp, E. coli
tccggcatgacaaagcgcacattga

SEQ ID NO: 222301 - DNA, 25 bp, E. coli
tcaaggcccgctctgcgggtctttt

SEQ ID NO: 222302 - DNA, 25 bp, E. coli
gcaaggtgattctgatgagaaatct

SEQ ID NO: 222303 - DNA, 25 bp, E. coli
tcaaggcccgctgtgcgggtctttt

SEQ ID NO: 222304 - DNA, 25 bp, E. coli
gcaaggtgattcagatgagaaatct

SEQ ID NO: 222305 - DNA, 25 bp, E. coli
ccattttgagtcagttgaaaaggaa

SEQ ID NO: 222306 - DNA, 25 bp, E. coli
ccattttgagtctgttgaaaaggaa

SEQ ID NO: 222307 - DNA, 25 bp, E. coli
cattgatatctgtctgagccccgct

SEQ ID NO: 222308 - DNA, 25 bp, E. coli
cattgatatctgactgagccccgct

SEQ ID NO: 222309 - DNA, 25 bp, E. coli
taaggcggcggagtgtatttctcca

SEQ ID NO: 222310 - DNA, 25 bp, E. coli
taaggcggcggactgtatttctcca

SEQ ID NO: 222311 - DNA, 25 bp, E. coli
gagaaatctgtgatctatttggcaa

SEQ ID NO: 222312 - DNA, 25 bp, E. coli
gtcagactgcccgtcataaggcggc

SEQ ID NO: 222313 - DNA, 25 bp, E. coli
gtcagactgcccctcataaggcggc

SEQ ID NO: 222314 - DNA, 25 bp, E. coli
gagaaatctgtgttctatttggcaa

SEQ ID NO: 222315 - DNA, 25 bp, E. coli
caatcagcgcgtacttgatcatatt

SEQ ID NO: 222316 - DNA, 25 bp, E. coli
caatcagcgcgttcttgatcatatt

SEQ ID NO: 222317 - DNA, 25 bp, E. coli
caaagcttattgtgatgaactaggt

SEQ ID NO: 222318 - DNA, 25 bp, E. coli
caaagcttattgagatgaactaggt

SEQ ID NO: 222319 - DNA, 25 bp, E. coli
cagggtgttgagctggacttcatgc

SEQ ID NO: 222320 - DNA, 25 bp, E. coli
cagggtgttgaggtggacttcatgc

SEQ ID NO: 222321 - DNA, 25 bp, E. coli
tattcaggtaaaaggtatcgcccct

SEQ ID NO: 222322 - DNA, 25 bp, E. coli
tattcaggtaaatggtatcgcccct

SEQ ID NO: 222323 - DNA, 25 bp, E. coli
tcgcccctggcttttatgcaacaga

SEQ ID NO: 222324 - DNA, 25 bp, E. coli
tcgcccctggctattatgcaacaga

SEQ ID NO: 222325 - DNA, 25 bp, E. coli
gctgtgagcgttacggtacagttga

SEQ ID NO: 222326 - DNA, 25 bp, E. coli
gctgtgagcgtttcggtacagttga

SEQ ID NO: 222327 - DNA, 25 bp, E. coli
cgtttcggtacagttgatattctgg

SEQ ID NO: 222328 - DNA, 25 bp, E. coli
cgtttcggtacacttgatattctgg

SEQ ID NO: 222329 - DNA, 25 bp, E. coli
gtaatccagaaaccaatcagcgcgt

SEQ ID NO: 222330 - DNA, 25 bp, E. coli
ggtaaatggtatcgcccctggctat

SEQ ID NO: 222331 - DNA, 25 bp, E. coli
gtaatccagaaagcaatcagcgcgt

SEQ ID NO: 222332 - DNA, 25 bp, E. coli
ggtaaatggtatggcccctggctat

SEQ ID NO: 222333 - DNA, 25 bp, E. coli
tgtgatgaactacgtcaatataata

SEQ ID NO: 222334 - DNA, 25 bp, E. coli
tgtgatgaactaggtcaatataata

SEQ ID NO: 222335 - DNA, 25 bp, E. coli
ggcgacacgcagtaatccagaaacc

SEQ ID NO: 222336 - DNA, 25 bp, E. coli
ggcgacacgcagaaatccagaaacc

SEQ ID NO: 222337 - DNA, 25 bp, E. coli
cagaaatgctgtgccgcaatatcgg

SEQ ID NO: 222338 - DNA, 25 bp, E. coli
cagaaatgctgtcccgcaatatcgg

SEQ ID NO: 222339 - DNA, 25 bp, E. coli
tatcggcattattcaacacggtgag

SEQ ID NO: 222340 - DNA, 25 bp, E. coli
tatcggcattatacaacacggtgag

SEQ ID NO: 222341 - DNA, 25 bp, E. coli
tttacgcagttaagtgagcagggca

SEQ ID NO: 222342 - DNA, 25 bp, E. coli
tttacgcagttatgtgagcagggca

SEQ ID NO: 222343 - DNA, 25 bp, E. coli
tgtggtgaatcaggcagggtactac

SEQ ID NO: 222344 - DNA, 25 bp, E. coli
tgtggtgaatcacgcagggtactac

SEQ ID NO: 222345 - DNA, 25 bp, E. coli
tgaaaccgtgcaccaaattgtggtg

SEQ ID NO: 222346 - DNA, 25 bp, E. coli
tgcgtaacaaagctaaccgtctgga

SEQ ID NO: 222347 - DNA, 25 bp, E. coli
tgaaaccgtgcagcaaattgtggtg

SEQ ID NO: 222348 - DNA, 25 bp, E. coli
tgcgtaacaaaggtaaccgtctgga

SEQ ID NO: 222349 - DNA, 25 bp, E. coli
gctctctggtaattaaaacctccgg

SEQ ID NO: 222350 - DNA, 25 bp, E. coli
gctctctggtaaataaaacctccgg

SEQ ID NO: 222351 - DNA, 25 bp, E. coli
gaagcgccgtttaatgattgcccgt

SEQ ID NO: 222352 - DNA, 25 bp, E. coli
gaagcgccgttttatgattgcccgt

SEQ ID NO: 222353 - DNA, 25 bp, E. coli
cgttaccgaagcacgatggctatca

SEQ ID NO: 222354 - DNA, 25 bp, E. coli
cgttaccgaagctcgatggctatca

SEQ ID NO: 222355 - DNA, 25 bp, E. coli
gatttaaacgacaaaggcaccacca

SEQ ID NO: 222356 - DNA, 25 bp, E. coli
gatttttatgcgcttctcgggccga

SEQ ID NO: 222357 - DNA, 25 bp, E. coli
gatttaaacgactaaggcaccacca

SEQ ID NO: 222358 - DNA, 25 bp, E. coli
gatttttatgcggttctcgggccga

SEQ ID NO: 222359 - DNA, 25 bp, E. coli
taacagataaaatgagaccgaacac

SEQ ID NO: 222360 - DNA, 25 bp, E. coli
taaaaagagaccgaacacgattcct

SEQ ID NO: 222361 - DNA, 25 bp, E. coli
taaaaagagacccaacacgattcct

SEQ ID NO: 222362 - DNA, 25 bp, E. coli
aaggaaatgcttgtggcttttaaca

SEQ ID NO: 222363 - DNA, 25 bp, E. coli
aaagtcagcgaaggaaatgcttctg

SEQ ID NO: 222364 - DNA, 25 bp, E. coli
aacacgattcctgtattcggtccag

SEQ ID NO: 222365 - DNA, 25 bp, E. coli
aaggaaatgcttctggcttttaaca

SEQ ID NO: 222366 - DNA, 25 bp, E. coli
aacacgattcctctattcggtccag

SEQ ID NO: 222367 - DNA, 25 bp, E. coli
aaagtcagcgaacgaaatgcttctg

SEQ ID NO: 222368 - DNA, 25 bp, E. coli
ttcggtccagggtaatggctcttgg

SEQ ID NO: 222369 - DNA, 25 bp, E. coli
ttcggtccagggaaatggctcttgg

SEQ ID NO: 222370 - DNA, 25 bp, E. coli
tcagcgaaggaaatgcttctggctt

SEQ ID NO: 222371 - DNA, 25 bp, E. coli
tcagcgaaggaattgcttctggctt

SEQ ID NO: 222372 - DNA, 25 bp, E. coli
tcttgggagagagccgtgcgctaaa

SEQ ID NO: 222373 - DNA, 25 bp, E. coli
tcttgggagagacccgtgcgctaaa

SEQ ID NO: 222374 - DNA, 25 bp, E. coli
gcttctggctttaaacagataaaaa

SEQ ID NO: 222375 - DNA, 25 bp, E. coli
gcttctggcttttaacagataaaaa

SEQ ID NO: 222376 - DNA, 25 bp, E. coli
gagaccgaacacgattcctgtattc

SEQ ID NO: 222377 - DNA, 25 bp, E. coli
gagaccgaacaccattcctgtattc

SEQ ID NO: 222378 - DNA, 25 bp, E. coli
tgtattcggtccagggaaatggctc

SEQ ID NO: 222379 - DNA, 25 bp, E. coli
tgtattcggtcctgggaaatggctc

SEQ ID NO: 222380 - DNA, 25 bp, E. coli
taacagataaaaagagaccgaacac

SEQ ID NO: 222381 - DNA, 25 bp, E. coli
caacatcaggaacaggttgatgaag

SEQ ID NO: 222382 - DNA, 25 bp, E. coli
caacatcaggaagaggttgatgaag

SEQ ID NO: 222383 - DNA, 25 bp, E. coli
caggaacaggttgatgaagtccaga

SEQ ID NO: 222384 - DNA, 25 bp, E. coli
catcaggaacagcttgatgaagtcc

SEQ ID NO: 222385 - DNA, 25 bp, E. coli
caggttgatgaactccagatacaag

SEQ ID NO: 222386 - DNA, 25 bp, E. coli
caggaacaggttcatgaagtccaga

SEQ ID NO: 222387 - DNA, 25 bp, E. coli
caggttgatgaagtccagatacaag

SEQ ID NO: 222388 - DNA, 25 bp, E. coli
catcaggaacaggttgatgaagtcc

SEQ ID NO: 222389 - DNA, 25 bp, E. coli
aacaggttgatgtagtccagataca

SEQ ID NO: 222390 - DNA, 25 bp, E. coli
aacaggttgatgaagtccagataca

SEQ ID NO: 222391 - DNA, 25 bp, E. coli
tgatgaagtccagatacaaggttaa

SEQ ID NO: 222392 - DNA, 25 bp, E. coli
tgatgaagtccacatacaaggttaa

SEQ ID NO: 222393 - DNA, 25 bp, E. coli
tcaggaacaggtagatgaagtccag

SEQ ID NO: 222394 - DNA, 25 bp, E. coli
tcaggaacaggttgatgaagtccag

SEQ ID NO: 222395 - DNA, 25 bp, E. coli
gaacaggttgatcaagtccagatac

SEQ ID NO: 222396 - DNA, 25 bp, E. coli
gaacaggttgatgaagtccagatac

SEQ ID NO: 222397 - DNA, 25 bp, E. coli
gttgatgaagtcgagatacaaggtt

SEQ ID NO: 222398 - DNA, 25 bp, E. coli
gttgatgaagtccagatacaaggtt

SEQ ID NO: 222399 - DNA, 25 bp, E. coli
ggttgatgaagtgcagatacaaggt

SEQ ID NO: 222400 - DNA, 25 bp, E. coli
ggttgatgaagtccagatacaaggt

SEQ ID NO: 222401 - DNA, 25 bp, E. coli
ggaacaggttgatgaagtccagata

SEQ ID NO: 222402 - DNA, 25 bp, E. coli
ggaacaggttgaagaagtccagata

SEQ ID NO: 222403 - DNA, 25 bp, E. coli
aagtcaaccttggtggcgatcctcg

SEQ ID NO: 222404 - DNA, 25 bp, E. coli
aaccttgaccgcgagacgggcgata

SEQ ID NO: 222405 - DNA, 25 bp, E. coli
aagtcaaccttgctggcgatcctcg

SEQ ID NO: 222406 - DNA, 25 bp, E. coli
caccggagttgacctggttgtcaaa

SEQ ID NO: 222407 - DNA, 25 bp, E. coli
caccggagttgagctggttgtcaaa

SEQ ID NO: 222408 - DNA, 25 bp, E. coli
cgaaagcgttgcacgaacagttagg

SEQ ID NO: 222409 - DNA, 25 bp, E. coli
cgaaagcgttgctcgaacagttagg

SEQ ID NO: 222410 - DNA, 25 bp, E. coli
aaccttgaccgccagacgggcgata

SEQ ID NO: 222411 - DNA, 25 bp, E. coli
ttaattcctaccgttaacgcgctgg

SEQ ID NO: 222412 - DNA, 25 bp, E. coli
ttaattcctacccttaacgcgctgg

SEQ ID NO: 222413 - DNA, 25 bp, E. coli
tcgggatcgggtaagtcaaccttgc

SEQ ID NO: 222414 - DNA, 25 bp, E. coli
tcgggatcgggttagtcaaccttgc

SEQ ID NO: 222415 - DNA, 25 bp, E. coli
ggttgtcaaacgaggcgagaccatc

SEQ ID NO: 222416 - DNA, 25 bp, E. coli
ggttgtcaaacgtggcgagaccatc

SEQ ID NO: 222417 - DNA, 25 bp, E. coli
taatatggacgaagaagcgcgggca

SEQ ID NO: 222418 - DNA, 25 bp, E. coli
taacgcgctggaaaacgtcgagctt

SEQ ID NO: 222419 - DNA, 25 bp, E. coli
taacgcgctggataacgtcgagctt

SEQ ID NO: 222420 - DNA, 25 bp, E. coli
taatatggacgatgaagcgcgggca

SEQ ID NO: 222421 - DNA, 25 bp, E. coli
gagtctggtgggacaaccgctacat

SEQ ID NO: 222422 - DNA, 25 bp, E. coli
gatgtgctgtttcccgacgaaccca

SEQ ID NO: 222423 - DNA, 25 bp, E. coli
gatgtgctgtttgccgacgaaccca

SEQ ID NO: 222424 - DNA, 25 bp, E. coli
gagtctggtgggtcaaccgctacat

SEQ ID NO: 222425 - DNA, 25 bp, E. coli
caaccacagatcaggctatggcgac

SEQ ID NO: 222426 - DNA, 25 bp, E. coli
caaccacagatctggctatggcgac

SEQ ID NO: 222427 - DNA, 25 bp, E. coli
tacgtcgacaaccacagatcaggct

SEQ ID NO: 222428 - DNA, 25 bp, E. coli
acgccgacatcagctgtggatacca

SEQ ID NO: 222429 - DNA, 25 bp, E. coli
agcggcaacaactacaccagatggc

SEQ ID NO: 222430 - DNA, 25 bp, E. coli
agcggcaacaacaacaccagatggc

SEQ ID NO: 222431 - DNA, 25 bp, E. coli
aggctatggcgaccacgccgacatc

SEQ ID NO: 222432 - DNA, 25 bp, E. coli
aggctatggcgagcacgccgacatc

SEQ ID NO: 222433 - DNA, 25 bp, E. coli
acgccgacatcacctgtggatacca

SEQ ID NO: 222434 - DNA, 25 bp, E. coli
caaagccagagtgtaccgttagata

SEQ ID NO: 222435 - DNA, 25 bp, E. coli
aacaacaacaccagatggcgctgcg

SEQ ID NO: 222436 - DNA, 25 bp, E. coli
aacaacaacacctgatggcgctgcg

SEQ ID NO: 222437 - DNA, 25 bp, E. coli
caaagccagagtctaccgttagata

SEQ ID NO: 222438 - DNA, 25 bp, E. coli
tacgtcgacaacgacagatcaggct

SEQ ID NO: 222439 - DNA, 25 bp, E. coli
tgtaccgttagaaacgtcgacaacc

SEQ ID NO: 222440 - DNA, 25 bp, E. coli
tgtaccgttagatacgtcgacaacc

SEQ ID NO: 222441 - DNA, 25 bp, E. coli
tgaataataatcaaagccagagtgt

SEQ ID NO: 222442 - DNA, 25 bp, E. coli
tgaataataatctaagccagagtgt

SEQ ID NO: 222443 - DNA, 25 bp, E. coli
tcttctgcggaagtgaataataatc

SEQ ID NO: 222444 - DNA, 25 bp, E. coli
tcttctgcggaactgaataataatc

SEQ ID NO: 222445 - DNA, 25 bp, E. coli
cgccggcggttgacccgaatgcgct

SEQ ID NO: 222446 - DNA, 25 bp, E. coli
cgccggcggttgtcccgaatgcgct

SEQ ID NO: 222447 - DNA, 25 bp, E. coli
tagtactttggaaccggctacaggt

SEQ ID NO: 222448 - DNA, 25 bp, E. coli
tagtactttggatccggctacaggt

SEQ ID NO: 222449 - DNA, 25 bp, E. coli
taccaacagtagtccgtcatccaat

SEQ ID NO: 222450 - DNA, 25 bp, E. coli
tatcatagggctgttcattgcttgc

SEQ ID NO: 222451 - DNA, 25 bp, E. coli
taccaacagtagaccgtcatccaat

SEQ ID NO: 222452 - DNA, 25 bp, E. coli
tatcatagggctcttcattgcttgc

SEQ ID NO: 222453 - DNA, 25 bp, E. coli
ttatttaaccttatctctgcagcgg

SEQ ID NO: 222454 - DNA, 25 bp, E. coli
ttatttaaccttttctctgcagcgg

SEQ ID NO: 222455 - DNA, 25 bp, E. coli
tcgccagtgggaatataccaacagt

SEQ ID NO: 222456 - DNA, 25 bp, E. coli
tcgccagtgggattataccaacagt

SEQ ID NO: 222457 - DNA, 25 bp, E. coli
tctgcagcggtttatcttactaacg

SEQ ID NO: 222458 - DNA, 25 bp, E. coli
tctgcagcggttaatcttactaacg

SEQ ID NO: 222459 - DNA, 25 bp, E. coli
gctttatcgataaccaacgcggtgc

SEQ ID NO: 222460 - DNA, 25 bp, E. coli
gcatagtctactcgctgctacagcg

SEQ ID NO: 222461 - DNA, 25 bp, E. coli
gcatagtctactggctgctacagcg

SEQ ID NO: 222462 - DNA, 25 bp, E. coli
gctttatcgatatccaacgcggtgc

SEQ ID NO: 222463 - DNA, 25 bp, E. coli
cgcggtgcaacgttaagtagtactt

SEQ ID NO: 222464 - DNA, 25 bp, E. coli
cgcggtgcaacgataagtagtactt

SEQ ID NO: 222465 - DNA, 25 bp, E. coli
gatatcgctttgatagctgcaagag

SEQ ID NO: 222466 - DNA, 25 bp, E. coli
gatatcgctttgttagctgcaagag

SEQ ID NO: 222467 - DNA, 25 bp, E. coli
ggctacaggtgtcgatacctcggaa

SEQ ID NO: 222468 - DNA, 25 bp, E. coli
ggctacaggtgtggatacctcggaa

SEQ ID NO: 222469 - DNA, 25 bp, E. coli
caaaatcgtgaagcaatcgggaccg

SEQ ID NO: 222470 - DNA, 25 bp, E. coli
caaaaaagcggatgagaaaggcgca

SEQ ID NO: 222471 - DNA, 25 bp, E. coli
caaaatcgtgaaccaatcgggaccg

SEQ ID NO: 222472 - DNA, 25 bp, E. coli
caaaaaagcggaagagaaaggcgca

SEQ ID NO: 222473 - DNA, 25 bp, E. coli
tatccgtaagtggtgtggcgtcttc

SEQ ID NO: 222474 - DNA, 25 bp, E. coli
tatccgtaagtgctgtggcgtcttc

SEQ ID NO: 222475 - DNA, 25 bp, E. coli
ttcgctgccgactccattgatgctg

SEQ ID NO: 222476 - DNA, 25 bp, E. coli
ttcgctgccgacaccattgatgctg

SEQ ID NO: 222477 - DNA, 25 bp, E. coli
gccaatggatatgcgtgaaatgctg

SEQ ID NO: 222478 - DNA, 25 bp, E. coli
gccaatggatatccgtgaaatgctg

SEQ ID NO: 222479 - DNA, 25 bp, E. coli
gcaacggcctaccagattactgaag

SEQ ID NO: 222480 - DNA, 25 bp, E. coli
gcaacggcctacgagattactgaag

SEQ ID NO: 222481 - DNA, 25 bp, E. coli
gaaaatcaaaacgactgttgctgca

SEQ ID NO: 222482 - DNA, 25 bp, E. coli
gaaaatcaaaaccactgttgctgca

SEQ ID NO: 222483 - DNA, 25 bp, E. coli
ggtcacgaaacaaaggcccagctaa

SEQ ID NO: 222484 - DNA, 25 bp, E. coli
ggtcacgaaacataggcccagctaa

SEQ ID NO: 222485 - DNA, 25 bp, E. coli
ggcccagctaaatgattatgtcgag

SEQ ID NO: 222486 - DNA, 25 bp, E. coli
ggcacgctacgggtgaactgtacaa

SEQ ID NO: 222487 - DNA, 25 bp, E. coli
ggcccagctaaaagattatgtcgag

SEQ ID NO: 222488 - DNA, 25 bp, E. coli
ggcacgctacggctgaactgtacaa

SEQ ID NO: 222489 - DNA, 25 bp, E. coli
gatgctgcacaagcacaaaatcgtg

SEQ ID NO: 222490 - DNA, 25 bp, E. coli
gatgctgcacaaccacaaaatcgtg

SEQ ID NO: 222491 - DNA, 25 bp, E. coli
caacaattgcaatttaccgggcggt

SEQ ID NO: 222492 - DNA, 25 bp, E. coli
caaatccggcgtcggtctattgcca

SEQ ID NO: 222493 - DNA, 25 bp, E. coli
caacaattgcaaattaccgggcggt

SEQ ID NO: 222494 - DNA, 25 bp, E. coli
caaatccggcgtgggtctattgcca

SEQ ID NO: 222495 - DNA, 25 bp, E. coli
acgattgatgaatgggcattgtggc

SEQ ID NO: 222496 - DNA, 25 bp, E. coli
acgattgatgaaagggcattgtggc

SEQ ID NO: 222497 - DNA, 25 bp, E. coli
taccgggcggtgaaacgattgatga

SEQ ID NO: 222498 - DNA, 25 bp, E. coli
taccgggcggtgtaacgattgatga

SEQ ID NO: 222499 - DNA, 25 bp, E. coli
ttctcagccagaagcacctaaaccg

SEQ ID NO: 222500 - DNA, 25 bp, E. coli
ttctcagccagatgcacctaaaccg

SEQ ID NO: 222501 - DNA, 25 bp, E. coli
tgttctgccttgcttgctggtcctg

SEQ ID NO: 222502 - DNA, 25 bp, E. coli
tgttctgccttggttgctggtcctg

SEQ ID NO: 222503 - DNA, 25 bp, E. coli
tgctggtcctggctggttgttcaac

SEQ ID NO: 222504 - DNA, 25 bp, E. coli
tgctggtcctgggtggttgttcaac

SEQ ID NO: 222505 - DNA, 25 bp, E. coli
tctattgccagctgaagggcgggac

SEQ ID NO: 222506 - DNA, 25 bp, E. coli
tctattgccagcagaagggcgggac

SEQ ID NO: 222507 - DNA, 25 bp, E. coli
gttgttcaaccccttctcagccaga

SEQ ID NO: 222508 - DNA, 25 bp, E. coli
gttgttcaacccgttctcagccaga

SEQ ID NO: 222509 - DNA, 25 bp, E. coli
tggtatggcaaatccggcgtcggtc

SEQ ID NO: 222510 - DNA, 25 bp, E. coli
tggtatggcaaaaccggcgtcggtc

SEQ ID NO: 222511 - DNA, 25 bp, E. coli
taaaccgccgcagattggtatggca

SEQ ID NO: 222512 - DNA, 25 bp, E. coli
taaaccgccgcacattggtatggca

SEQ ID NO: 222513 - DNA, 25 bp, E. coli
aacgctcccggttgcgataatctta

SEQ ID NO: 222514 - DNA, 25 bp, E. coli
acgctcccggtagcgataatcttaa

SEQ ID NO: 222515 - DNA, 25 bp, E. coli
atttgtctgaccctatccggtgcgc

SEQ ID NO: 222516 - DNA, 25 bp, E. coli
acgctcccggtaccgataatcttaa

SEQ ID NO: 222517 - DNA, 25 bp, E. coli
atttgtctgaccgtatccggtgcgc

SEQ ID NO: 222518 - DNA, 25 bp, E. coli
aacgctcccggtagcgataatctta

SEQ ID NO: 222519 - DNA, 25 bp, E. coli
ttgtctgaccgtatccggtgcgcct

SEQ ID NO: 222520 - DNA, 25 bp, E. coli
ttgtctgaccgtttccggtgcgcct

SEQ ID NO: 222521 - DNA, 25 bp, E. coli
tgtctcgacgaaggctcccggtagc

SEQ ID NO: 222522 - DNA, 25 bp, E. coli
tgtctcgacgaacgctcccggtagc

SEQ ID NO: 222523 - DNA, 25 bp, E. coli
tctcgacgaacgctcccggtagcga

SEQ ID NO: 222524 - DNA, 25 bp, E. coli
tcgacgaacgctgccggtagcgata

SEQ ID NO: 222525 - DNA, 25 bp, E. coli
tcgacgaacgctcccggtagcgata

SEQ ID NO: 222526 - DNA, 25 bp, E. coli
tctcgacgaacggtcccggtagcga

SEQ ID NO: 222527 - DNA, 25 bp, E. coli
ccatttgtctgaccgtatccggtgc

SEQ ID NO: 222528 - DNA, 25 bp, E. coli
gccatttgtctgtccgtatccggtg

SEQ ID NO: 222529 - DNA, 25 bp, E. coli
ccatttgtctgagcgtatccggtgc

SEQ ID NO: 222530 - DNA, 25 bp, E. coli
gccatttgtctgaccgtatccggtg

SEQ ID NO: 222531 - DNA, 25 bp, E. coli
cgaacgctcccggtagcgataatct

SEQ ID NO: 222532 - DNA, 25 bp, E. coli
cgaacgctcccgctagcgataatct

SEQ ID NO: 222533 - DNA, 25 bp, E. coli
gttatgaattcagggacacgctggg

SEQ ID NO: 222534 - DNA, 25 bp, E. coli
gttatgaattcacggacacgctggg

SEQ ID NO: 222535 - DNA, 25 bp, E. coli
caatgtctctgagtgcctgttctaa

SEQ ID NO: 222536 - DNA, 25 bp, E. coli
caatgtctctgactgcctgttctaa

SEQ ID NO: 222537 - DNA, 25 bp, E. coli
aacgggaccgcaacaccgcaatcgg

SEQ ID NO: 222538 - DNA, 25 bp, E. coli
aacgggaccgcatcaccgcaatcgg

SEQ ID NO: 222539 - DNA, 25 bp, E. coli
tgaccgcggctgttctggcaattac

SEQ ID NO: 222540 - DNA, 25 bp, E. coli
tgaccgcggctgatctggcaattac

SEQ ID NO: 222541 - DNA, 25 bp, E. coli
tctaactggtctaaacgggaccgca

SEQ ID NO: 222542 - DNA, 25 bp, E. coli
tctaactggtcttaacgggaccgca

SEQ ID NO: 222543 - DNA, 25 bp, E. coli
tggtctaaacgggaccgcaacaccg

SEQ ID NO: 222544 - DNA, 25 bp, E. coli
ggtgcagtactgaccgatggcagta

SEQ ID NO: 222545 - DNA, 25 bp, E. coli
ggtgcagtactgtccgatggcagta

SEQ ID NO: 222546 - DNA, 25 bp, E. coli
tggtctaaacggcaccgcaacaccg

SEQ ID NO: 222547 - DNA, 25 bp, E. coli
tggcagtacgttcggtacattaggt

SEQ ID NO: 222548 - DNA, 25 bp, E. coli
tggcagtacgttgggtacattaggt

SEQ ID NO: 222549 - DNA, 25 bp, E. coli
ggcattaggcggagcagtactgacc

SEQ ID NO: 222550 - DNA, 25 bp, E. coli
ggcattaggcggtgcagtactgacc

SEQ ID NO: 222551 - DNA, 25 bp, E. coli
taacgagcaaaaaaatgaccgcggc

SEQ ID NO: 222552 - DNA, 25 bp, E. coli
taacgagcaaaataatgaccgcggc

SEQ ID NO: 222553 - DNA, 25 bp, E. coli
gagtgcctgttcaaactggtctaaa

SEQ ID NO: 222554 - DNA, 25 bp, E. coli
gagtgcctgttctaactggtctaaa

SEQ ID NO: 222555 - DNA, 25 bp, E. coli
gaccgatggcagtacgttgggtaca

SEQ ID NO: 222556 - DNA, 25 bp, E. coli
gaccgatggcagaacgttgggtaca

SEQ ID NO: 222557 - DNA, 25 bp, E. coli
caatggtattgctattccacacggc

SEQ ID NO: 222558 - DNA, 25 bp, E. coli
caatggtattgcaattccacacggc

SEQ ID NO: 222559 - DNA, 25 bp, E. coli
caaatgcttttgttgtggacggcga

SEQ ID NO: 222560 - DNA, 25 bp, E. coli
caaatgcttttgatgtggacggcga

SEQ ID NO: 222561 - DNA, 25 bp, E. coli
cacttggcgttatgaaaggtcatcg

SEQ ID NO: 222562 - DNA, 25 bp, E. coli
cacttggcgttaagaaaggtcatcg

SEQ ID NO: 222563 - DNA, 25 bp, E. coli
tatccgtacaggacatccatccggg

SEQ ID NO: 222564 - DNA, 25 bp, E. coli
tatccgtacaggtcatccatccggg

SEQ ID NO: 222565 - DNA, 25 bp, E. coli
tgtggtgcgcaatgaacacggcctg

SEQ ID NO: 222566 - DNA, 25 bp, E. coli
tgtggtgcgcaaagaacacggcctg

SEQ ID NO: 222567 - DNA, 25 bp, E. coli
tgctgaaagcggatgcggcaacgtt

SEQ ID NO: 222568 - DNA, 25 bp, E. coli
tgctgaaagcggttgcggcaacgtt

SEQ ID NO: 222569 - DNA, 25 bp, E. coli
gcaaaccggcaaacggacgtagtct

SEQ ID NO: 222570 - DNA, 25 bp, E. coli
gcaaaccggcaatcggacgtagtct

SEQ ID NO: 222571 - DNA, 25 bp, E. coli
gaaggctacgtcaatggcatgctgg

SEQ ID NO: 222572 - DNA, 25 bp, E. coli
gaaggctacgtctatggcatgctgg

SEQ ID NO: 222573 - DNA, 25 bp, E. coli
cgatagcgccgaaggcaatctgcgt

SEQ ID NO: 222574 - DNA, 25 bp, E. coli
cgatagcgccgatggcaatctgcgt

SEQ ID NO: 222575 - DNA, 25 bp, E. coli
gatcaggtgctgaaaaccggcgttc

SEQ ID NO: 222576 - DNA, 25 bp, E. coli
gatcaggtgctgtaaaccggcgttc

SEQ ID NO: 222577 - DNA, 25 bp, E. coli
ggcgttcaggtatttcagttcccgg

SEQ ID NO: 222578 - DNA, 25 bp, E. coli
ggcgttcaggtaattcagttcccgg

SEQ ID NO: 222579 - DNA, 25 bp, E. coli
aatccttgctatcggtggttaatca

SEQ ID NO: 222580 - DNA, 25 bp, E. coli
aatccttgctatgggtggttaatca

SEQ ID NO: 222581 - DNA, 25 bp, E. coli
caaaagtaatccatgctatgggtgg

SEQ ID NO: 222582 - DNA, 25 bp, E. coli
caaaagtaatccttgctatgggtgg

SEQ ID NO: 222583 - DNA, 25 bp, E. coli
cagaatgacacgatttattaataaa

SEQ ID NO: 222584 - DNA, 25 bp, E. coli
cagaatgacacgttttattaataaa

SEQ ID NO: 222585 - DNA, 25 bp, E. coli
catcgcggaatgaaaaatttaaata

SEQ ID NO: 222586 - DNA, 25 bp, E. coli
catcgcggaatgtaaaatttaaata

SEQ ID NO: 222587 - DNA, 25 bp, E. coli
taaaaaggactcatccatgagccaa

SEQ ID NO: 222588 - DNA, 25 bp, E. coli
taaaaggtcttattcagaatgacac

SEQ ID NO: 222589 - DNA, 25 bp, E. coli
taaaaaggactcttccatgagccaa

SEQ ID NO: 222590 - DNA, 25 bp, E. coli
taaatcggaacaattacatcgcgga

SEQ ID NO: 222591 - DNA, 25 bp, E. coli
taaagctattctatcattgctgtgt

SEQ ID NO: 222592 - DNA, 25 bp, E. coli
taaagctattctttcattgctgtgt

SEQ ID NO: 222593 - DNA, 25 bp, E. coli
taaaaggtcttaatcagaatgacac

SEQ ID NO: 222594 - DNA, 25 bp, E. coli
taaatcggaacatttacatcgcgga

SEQ ID NO: 222595 - DNA, 25 bp, E. coli
gcccaagggctaatttcttcaaaag

SEQ ID NO: 222596 - DNA, 25 bp, E. coli
gccaaaattcctcaaatcttaaggg

SEQ ID NO: 222597 - DNA, 25 bp, E. coli
gccaaaattcctgaaatcttaaggg

SEQ ID NO: 222598 - DNA, 25 bp, E. coli
gcccaagggctattttcttcaaaag

SEQ ID NO: 222599 - DNA, 25 bp, E. coli
cattgctgtgtttttctttacaaaa

SEQ ID NO: 222600 - DNA, 25 bp, E. coli
cattgctgtgttattctttacaaaa

SEQ ID NO: 222601 - DNA, 25 bp, E. coli
aattgttggcctccaaacggatgcg

SEQ ID NO: 222602 - DNA, 25 bp, E. coli
aattgttggcctgcaaacggatgcg

SEQ ID NO: 222603 - DNA, 25 bp, E. coli
cagagcatcgtcatgcgctgttgca

SEQ ID NO: 222604 - DNA, 25 bp, E. coli
cagagcatcgtcttgcgctgttgca

SEQ ID NO: 222605 - DNA, 25 bp, E. coli
aaaaggcgaggatctggaagccacc

SEQ ID NO: 222606 - DNA, 25 bp, E. coli
aaaaggcgaggaactggaagccacc

SEQ ID NO: 222607 - DNA, 25 bp, E. coli
tatcggtgactatcgccgcgtagcg

SEQ ID NO: 222608 - DNA, 25 bp, E. coli
tttgatatctctcgcccggcgcaga

SEQ ID NO: 222609 - DNA, 25 bp, E. coli
tatcggtgactaacgccgcgtagcg

SEQ ID NO: 222610 - DNA, 25 bp, E. coli
tttgatatctctggcccggcgcaga

SEQ ID NO: 222611 - DNA, 25 bp, E. coli
tgcatggtcgtgaccgcaaaggtgc

SEQ ID NO: 222612 - DNA, 25 bp, E. coli
tgcatggtcgtgtccgcaaaggtgc

SEQ ID NO: 222613 - DNA, 25 bp, E. coli
tcgacggtgaatttccgcagtacgg

SEQ ID NO: 222614 - DNA, 25 bp, E. coli
tcgacggtgaatatccgcagtacgg

SEQ ID NO: 222615 - DNA, 25 bp, E. coli
cctggcggtggagtttgaaatcgac

SEQ ID NO: 222616 - DNA, 25 bp, E. coli
cctggcggtggactttgaaatcgac

SEQ ID NO: 222617 - DNA, 25 bp, E. coli
cgatcgtcacctgttccttgcagta

SEQ ID NO: 222618 - DNA, 25 bp, E. coli
ccgcgtagcgctgtatggcatcagt

SEQ ID NO: 222619 - DNA, 25 bp, E. coli
cccacgcgccggatgatttcgatac

SEQ ID NO: 222620 - DNA, 25 bp, E. coli
cccacgcgccggttgatttcgatac

SEQ ID NO: 222621 - DNA, 25 bp, E. coli
ccgcgtagcgctctatggcatcagt

SEQ ID NO: 222622 - DNA, 25 bp, E. coli
cgatcgtcacctcttccttgcagta

SEQ ID NO: 222623 - DNA, 25 bp, E. coli
aaaattccaggcgtgcttgacggcg

SEQ ID NO: 222624 - DNA, 25 bp, E. coli
aaaattccaggcctgcttgacggcg

SEQ ID NO: 222625 - DNA, 25 bp, E. coli
tattcaacgtctaacgcgtgagacg

SEQ ID NO: 222626 - DNA, 25 bp, E. coli
tattcaacgtcttacgcgtgagacg

SEQ ID NO: 222627 - DNA, 25 bp, E. coli
ttgagcgaggcagatgcgatcgcct

SEQ ID NO: 222628 - DNA, 25 bp, E. coli
ttgagcgaggcacatgcgatcgcct

SEQ ID NO: 222629 - DNA, 25 bp, E. coli
tgatctgtgcgcttatggacgaagt

SEQ ID NO: 222630 - DNA, 25 bp, E. coli
tgatctgtgcgcatatggacgaagt

SEQ ID NO: 222631 - DNA, 25 bp, E. coli
tgagacggttgttcaactgacggat

SEQ ID NO: 222632 - DNA, 25 bp, E. coli
tgagacggttgtacaactgacggat

SEQ ID NO: 222633 - DNA, 25 bp, E. coli
gctaaccatcgcgagattggtaacg

SEQ ID NO: 222634 - DNA, 25 bp, E. coli
gctaaccatcgccagattggtaacg

SEQ ID NO: 222635 - DNA, 25 bp, E. coli
ccgatgctggtgttaagcgacaagt

SEQ ID NO: 222636 - DNA, 25 bp, E. coli
ccgatgctggtgataagcgacaagt

SEQ ID NO: 222637 - DNA, 25 bp, E. coli
cgtgaagagtgctaaattccaggcc

SEQ ID NO: 222638 - DNA, 25 bp, E. coli
cgatcgcctcctgggaacaggaagt

SEQ ID NO: 222639 - DNA, 25 bp, E. coli
cgtgaagagtgcaaaattccaggcc

SEQ ID NO: 222640 - DNA, 25 bp, E. coli
cgatcgcctcctcggaacaggaagt

SEQ ID NO: 222641 - DNA, 25 bp, E. coli
gggaaagcctttcatgaccgcctcg

SEQ ID NO: 222642 - DNA, 25 bp, E. coli
gtgggatttatggtgcgcagcatct

SEQ ID NO: 222643 - DNA, 25 bp, E. coli
gggaaagcctttgatgaccgcctcg

SEQ ID NO: 222644 - DNA, 25 bp, E. coli
gtgggatttatgctgcgcagcatct

SEQ ID NO: 222645 - DNA, 25 bp, E. coli
catttgtctggtgattacactacta

SEQ ID NO: 222646 - DNA, 25 bp, E. coli
catttgtctggtcattacactacta

SEQ ID NO: 222647 - DNA, 25 bp, E. coli
accgcattgacactgccgagcagtt

SEQ ID NO: 222648 - DNA, 25 bp, E. coli
accgcattgacagtgccgagcagtt

SEQ ID NO: 222649 - DNA, 25 bp, E. coli
tattgataaggtagcttcgtcgtca

SEQ ID NO: 222650 - DNA, 25 bp, E. coli
tattgataaggttgcttcgtcgtca

SEQ ID NO: 222651 - DNA, 25 bp, E. coli
tgtctggtcatttcactactaatga

SEQ ID NO: 222652 - DNA, 25 bp, E. coli
tgtctggtcattacactactaatga

SEQ ID NO: 222653 - DNA, 25 bp, E. coli
tcattacactactaatgacactccc

SEQ ID NO: 222654 - DNA, 25 bp, E. coli
tcattacactacaaatgacactccc

SEQ ID NO: 222655 - DNA, 25 bp, E. coli
gcagtttattgaaaaggttgcttcg

SEQ ID NO: 222656 - DNA, 25 bp, E. coli
gcagtttattgataaggttgcttcg

SEQ ID NO: 222657 - DNA, 25 bp, E. coli
ccgtaaccgcatagacactgccgag

SEQ ID NO: 222658 - DNA, 25 bp, E. coli
cgagcagtttatagataaggttgct

SEQ ID NO: 222659 - DNA, 25 bp, E. coli
ccgtaaccgcattgacactgccgag

SEQ ID NO: 222660 - DNA, 25 bp, E. coli
cgagcagtttattgataaggttgct

SEQ ID NO: 222661 - DNA, 25 bp, E. coli
gataaggttgctacgtcgtcatcga

SEQ ID NO: 222662 - DNA, 25 bp, E. coli
gataaggttgcttcgtcgtcatcga

SEQ ID NO: 222663 - DNA, 25 bp, E. coli
taaggttgcttcctcgtcatcgatt

SEQ ID NO: 222664 - DNA, 25 bp, E. coli
taaccgcattgacactgccgagcag

SEQ ID NO: 222665 - DNA, 25 bp, E. coli
taaggttgcttcgtcgtcatcgatt

SEQ ID NO: 222666 - DNA, 25 bp, E. coli
taaccgcattgagactgccgagcag

SEQ ID NO: 222667 - DNA, 25 bp, E. coli
agacaactcgcaacgccgaagtgcc

SEQ ID NO: 222668 - DNA, 25 bp, E. coli
atccggagacaactcgcatcgccga

SEQ ID NO: 222669 - DNA, 25 bp, E. coli
atccggagacaagtcgcatcgccga

SEQ ID NO: 222670 - DNA, 25 bp, E. coli
agacaactcgcatcgccgaagtgcc

SEQ ID NO: 222671 - DNA, 25 bp, E. coli
tcgcatcgccgatgtgcccgcaagg

SEQ ID NO: 222672 - DNA, 25 bp, E. coli
tcgcatcgccgaagtgcccgcaagg

SEQ ID NO: 222673 - DNA, 25 bp, E. coli
gcgtgacagagggattgagcggcag

SEQ ID NO: 222674 - DNA, 25 bp, E. coli
cctcgagatgcgtgacagagggatt

SEQ ID NO: 222675 - DNA, 25 bp, E. coli
cctcgagatgcgagacagagggatt

SEQ ID NO: 222676 - DNA, 25 bp, E. coli
gcgtgacagaggcattgagcggcag

SEQ ID NO: 222677 - DNA, 25 bp, E. coli
gcatcgccgaagtgcccgcaagggc

SEQ ID NO: 222678 - DNA, 25 bp, E. coli
gcatcgccgaagagcccgcaagggc

SEQ ID NO: 222679 - DNA, 25 bp, E. coli
gtaacgggatgagtattcccccgat

SEQ ID NO: 222680 - DNA, 25 bp, E. coli
gtaacgggatgactattcccccgat

SEQ ID NO: 222681 - DNA, 25 bp, E. coli
ggagacaactcgcatcgccgaagtg

SEQ ID NO: 222682 - DNA, 25 bp, E. coli
gggatgagtattgccccgatccgga

SEQ ID NO: 222683 - DNA, 25 bp, E. coli
gggatgagtattcccccgatccgga

SEQ ID NO: 222684 - DNA, 25 bp, E. coli
ggagacaactcggatcgccgaagtg

SEQ ID NO: 222685 - DNA, 25 bp, E. coli
gagtattccccccatccggagacaa

SEQ ID NO: 222686 - DNA, 25 bp, E. coli
gagtattcccccgatccggagacaa

SEQ ID NO: 222687 - DNA, 25 bp, E. coli
gagacaactcgcatcgccgaagtgc

SEQ ID NO: 222688 - DNA, 25 bp, E. coli
gagacaactcgcttcgccgaagtgc

SEQ ID NO: 222689 - DNA, 25 bp, E. coli
caatgtgttacgaatcggtggcaag

SEQ ID NO: 222690 - DNA, 25 bp, E. coli
aatgtgttacgtatcggtggcaagg

SEQ ID NO: 222691 - DNA, 25 bp, E. coli
aatccaggcgcaaccaatgtgttac

SEQ ID NO: 222692 - DNA, 25 bp, E. coli
caaccaatgtgtaacgtatcggtgg

SEQ ID NO: 222693 - DNA, 25 bp, E. coli
aatgtgttacgtttcggtggcaagg

SEQ ID NO: 222694 - DNA, 25 bp, E. coli
caatgtgttacgtatcggtggcaag

SEQ ID NO: 222695 - DNA, 25 bp, E. coli
aatccaggcgcatccaatgtgttac

SEQ ID NO: 222696 - DNA, 25 bp, E. coli
caaccaatgtgttacgtatcggtgg

SEQ ID NO: 222697 - DNA, 25 bp, E. coli
caggcgcaaccaatgtgttacgtat

SEQ ID NO: 222698 - DNA, 25 bp, E. coli
caggcgcaaccattgtgttacgtat

SEQ ID NO: 222699 - DNA, 25 bp, E. coli
accaatgtgttacgtatcggtggca

SEQ ID NO: 222700 - DNA, 25 bp, E. coli
accaatgtgttaggtatcggtggca

SEQ ID NO: 222701 - DNA, 25 bp, E. coli
tccaggcgcaacgaatgtgttacgt

SEQ ID NO: 222702 - DNA, 25 bp, E. coli
tccaggcgcaaccaatgtgttacgt

SEQ ID NO: 222703 - DNA, 25 bp, E. coli
gcaatccaggcggaaccaatgtgtt

SEQ ID NO: 222704 - DNA, 25 bp, E. coli
gcaatccaggcgcaaccaatgtgtt

SEQ ID NO: 222705 - DNA, 25 bp, E. coli
cgcaaccaatgtcttacgtatcggt

SEQ ID NO: 222706 - DNA, 25 bp, E. coli
cgcaaccaatgtgttacgtatcggt

SEQ ID NO: 222707 - DNA, 25 bp, E. coli
tgtgttacgtatgggtggcaaggga

SEQ ID NO: 222708 - DNA, 25 bp, E. coli
tgtgttacgtatcggtggcaaggga

SEQ ID NO: 222709 - DNA, 25 bp, E. coli
ggcgcaaccaatctgttacgtatcg

SEQ ID NO: 222710 - DNA, 25 bp, E. coli
ggcgcaaccaatgtgttacgtatcg

SEQ ID NO: 222711 - DNA, 25 bp, E. coli
caactactggaaagtgcgtcaggct

SEQ ID NO: 222712 - DNA, 25 bp, E. coli
caactactggaatgtgcgtcaggct

SEQ ID NO: 222713 - DNA, 25 bp, E. coli
catgaactgattcccgcgtctgaac

SEQ ID NO: 222714 - DNA, 25 bp, E. coli
catgaactgattgccgcgtctgaac

SEQ ID NO: 222715 - DNA, 25 bp, E. coli
tactggctcaatcgaagcggtctgc

SEQ ID NO: 222716 - DNA, 25 bp, E. coli
tactggctcaatggaagcggtctgc

SEQ ID NO: 222717 - DNA, 25 bp, E. coli
tgtcgagacggctaaagagacgctc

SEQ ID NO: 222718 - DNA, 25 bp, E. coli
tggtcgcggagctacaactgccgat

SEQ ID NO: 222719 - DNA, 25 bp, E. coli
tggtcgcggagcaacaactgccgat

SEQ ID NO: 222720 - DNA, 25 bp, E. coli
tgtcgagacggcaaaagagacgctc

SEQ ID NO: 222721 - DNA, 25 bp, E. coli
tgaaaacgaacaagagcgaaccgcg

SEQ ID NO: 222722 - DNA, 25 bp, E. coli
tgaaaacgaacatgagcgaaccgcg

SEQ ID NO: 222723 - DNA, 25 bp, E. coli
gactccggcggtttctcgatcaagc

SEQ ID NO: 222724 - DNA, 25 bp, E. coli
gactccggcggtatctcgatcaagc

SEQ ID NO: 222725 - DNA, 25 bp, E. coli
gattgagtacaaaggcaacgcgtcg

SEQ ID NO: 222726 - DNA, 25 bp, E. coli
gattgagtacaatggcaacgcgtcg

SEQ ID NO: 222727 - DNA, 25 bp, E. coli
tcgtccgggcgatgtgttaaccacc

SEQ ID NO: 222728 - DNA, 25 bp, E. coli
tcgtccgggcgaagtgttaaccacc

SEQ ID NO: 222729 - DNA, 25 bp, E. coli
tcagcgatgggttcatcagcgccct

SEQ ID NO: 222730 - DNA, 25 bp, E. coli
tcagcgatgggtacatcagcgccct

SEQ ID NO: 222731 - DNA, 25 bp, E. coli
gatgcattcctatctggcggtcggt

SEQ ID NO: 222732 - DNA, 25 bp, E. coli
gatgcattcctaactggcggtcggt

SEQ ID NO: 222733 - DNA, 25 bp, E. coli
cacgacgtgaagaattgaagagttt

SEQ ID NO: 222734 - DNA, 25 bp, E. coli
cacgacgtgaagtattgaagagttt

SEQ ID NO: 222735 - DNA, 25 bp, E. coli
catatgtgatgggaaaagcggtcga

SEQ ID NO: 222736 - DNA, 25 bp, E. coli
catatgtgatggcaaaagcggtcga

SEQ ID NO: 222737 - DNA, 25 bp, E. coli
agatctcccagggacgacgtgaaga

SEQ ID NO: 222738 - DNA, 25 bp, E. coli
agatctcccaggcacgacgtgaaga

SEQ ID NO: 222739 - DNA, 25 bp, E. coli
actcaccccccaagaagaggcgata

SEQ ID NO: 222740 - DNA, 25 bp, E. coli
actcaccccccatgaagaggcgata

SEQ ID NO: 222741 - DNA, 25 bp, E. coli
tcaggctcttcatatgtgatgggaa

SEQ ID NO: 222742 - DNA, 25 bp, E. coli
tcaggctcttcaaatgtgatgggaa

SEQ ID NO: 222743 - DNA, 25 bp, E. coli
tcagaaaaacctggaaaagatctcc

SEQ ID NO: 222744 - DNA, 25 bp, E. coli
ccatgaagaggcgatattatcaaat

SEQ ID NO: 222745 - DNA, 25 bp, E. coli
ccatgaagaggccatattatcaaat

SEQ ID NO: 222746 - DNA, 25 bp, E. coli
gaaccactatttgccgcaggaatgg

SEQ ID NO: 222747 - DNA, 25 bp, E. coli
gaaccactatttcccgcaggaatgg

SEQ ID NO: 222748 - DNA, 25 bp, E. coli
cccaggcacgacctgaagaattgaa

SEQ ID NO: 222749 - DNA, 25 bp, E. coli
cccaggcacgacgtgaagaattgaa

SEQ ID NO: 222750 - DNA, 25 bp, E. coli
tggaaaagatctgccaggcacgacg

SEQ ID NO: 222751 - DNA, 25 bp, E. coli
tggaaaagatctcccaggcacgacg

SEQ ID NO: 222752 - DNA, 25 bp, E. coli
tcagaaaaacctcgaaaagatctcc

SEQ ID NO: 222753 - DNA, 25 bp, E. coli
gaggcgatattaacaaatatcagct

SEQ ID NO: 222754 - DNA, 25 bp, E. coli
gaggcgatattatcaaatatcagct

SEQ ID NO: 222755 - DNA, 25 bp, E. coli
aattaccgaactgtggctcggcggc

SEQ ID NO: 222756 - DNA, 25 bp, E. coli
aattaccgaactctggctcggcggc

SEQ ID NO: 222757 - DNA, 25 bp, E. coli
aattgcgcgaagtaggtacgtcata

SEQ ID NO: 222758 - DNA, 25 bp, E. coli
aattgcgcgaagaaggtacgtcata

SEQ ID NO: 222759 - DNA, 25 bp, E. coli
taggatgcagcgagctttacaactt

SEQ ID NO: 222760 - DNA, 25 bp, E. coli
tatggctgcgcaagggattttttac

SEQ ID NO: 222761 - DNA, 25 bp, E. coli
taggatgcagcgtgctttacaactt

SEQ ID NO: 222762 - DNA, 25 bp, E. coli
tatggctgcgcatgggattttttac

SEQ ID NO: 222763 - DNA, 25 bp, E. coli
ttcttgaggataggcagtttatacc

SEQ ID NO: 222764 - DNA, 25 bp, E. coli
ttcttgaggatacgcagtttatacc

SEQ ID NO: 222765 - DNA, 25 bp, E. coli
tgttgcaaccgaatatgcgaacacg

SEQ ID NO: 222766 - DNA, 25 bp, E. coli
tgttgcaaccgattatgcgaacacg

SEQ ID NO: 222767 - DNA, 25 bp, E. coli
tcgtattagtttcaagagacacgct

SEQ ID NO: 222768 - DNA, 25 bp, E. coli
tcgtattagtttgaagagacacgct

SEQ ID NO: 222769 - DNA, 25 bp, E. coli
gctagcgaattgttgatgagtccaa

SEQ ID NO: 222770 - DNA, 25 bp, E. coli
gctagcgaattgatgatgagtccaa

SEQ ID NO: 222771 - DNA, 25 bp, E. coli
gacattagcccgaattgctagcgaa

SEQ ID NO: 222772 - DNA, 25 bp, E. coli
gacattagcccgtattgctagcgaa

SEQ ID NO: 222773 - DNA, 25 bp, E. coli
cgatcggcgcaggaattaccgaact

SEQ ID NO: 222774 - DNA, 25 bp, E. coli
cgatcggcgcagcaattaccgaact

SEQ ID NO: 222775 - DNA, 25 bp, E. coli
gttacttctgaacgtgttgcaaccg

SEQ ID NO: 222776 - DNA, 25 bp, E. coli
gttacttctgaaggtgttgcaaccg

SEQ ID NO: 222777 - DNA, 25 bp, E. coli
cactggcagcgcctttaattggcct

SEQ ID NO: 222778 - DNA, 25 bp, E. coli
cactggcagcgcgtttaattggcct

SEQ ID NO: 222779 - DNA, 25 bp, E. coli
cagggagatcaaacactggcgaacg

SEQ ID NO: 222780 - DNA, 25 bp, E. coli
gacggcttcggggtgcatcttttcg

SEQ ID NO: 222781 - DNA, 25 bp, E. coli
gacggcttcgggctgcatcttttcg

SEQ ID NO: 222782 - DNA, 25 bp, E. coli
cagggagatcaatcactggcgaacg

SEQ ID NO: 222783 - DNA, 25 bp, E. coli
actgggtgtggctacgtcactggca

SEQ ID NO: 222784 - DNA, 25 bp, E. coli
actgggtgtggcaacgtcactggca

SEQ ID NO: 222785 - DNA, 25 bp, E. coli
tatacgctgttttacggttcaggga

SEQ ID NO: 222786 - DNA, 25 bp, E. coli
tatacgctgtttaacggttcaggga

SEQ ID NO: 222787 - DNA, 25 bp, E. coli
ttaattggccttctgggtgctgacg

SEQ ID NO: 222788 - DNA, 25 bp, E. coli
ttaattggccttgtgggtgctgacg

SEQ ID NO: 222789 - DNA, 25 bp, E. coli
tttaacggttcagggaaattgcagg

SEQ ID NO: 222790 - DNA, 25 bp, E. coli
tttaacggttcacggaaattgcagg

SEQ ID NO: 222791 - DNA, 25 bp, E. coli
gatactgggtgtcgcaacgtcactg

SEQ ID NO: 222792 - DNA, 25 bp, E. coli
gatactgggtgtggcaacgtcactg

SEQ ID NO: 222793 - DNA, 25 bp, E. coli
ggcaacgtcactggcagcgccttta

SEQ ID NO: 222794 - DNA, 25 bp, E. coli
ggcggcaacagggagatcaaacact

SEQ ID NO: 222795 - DNA, 25 bp, E. coli
ggcaacgtcactcgcagcgccttta

SEQ ID NO: 222796 - DNA, 25 bp, E. coli
ggcggcaacaggcagatcaaacact

SEQ ID NO: 222797 - DNA, 25 bp, E. coli
gatggcggcaactgggagatcaaac

SEQ ID NO: 222798 - DNA, 25 bp, E. coli
gatggcggcaacagggagatcaaac

SEQ ID NO: 222799 - DNA, 25 bp, E. coli
agatcaccgccaatcgtgcgcaggg

SEQ ID NO: 222800 - DNA, 25 bp, E. coli
agatcaccgccattcgtgcgcaggg

SEQ ID NO: 222801 - DNA, 25 bp, E. coli
aaaatcaagcgtgaaggcgatgcgc

SEQ ID NO: 222802 - DNA, 25 bp, E. coli
aaaatcaagcgtcaaggcgatgcgc

SEQ ID NO: 222803 - DNA, 25 bp, E. coli
ttacaaagagcgactgctcgccgcc

SEQ ID NO: 222804 - DNA, 25 bp, E. coli
ttacaaagagcgtctgctcgccgcc

SEQ ID NO: 222805 - DNA, 25 bp, E. coli
ttcatctgcgttttgacattcgggc

SEQ ID NO: 222806 - DNA, 25 bp, E. coli
ttgtcattaaggcacaggaataccg

SEQ ID NO: 222807 - DNA, 25 bp, E. coli
ttcatctgcgttatgacattcgggc

SEQ ID NO: 222808 - DNA, 25 bp, E. coli
ttgtcattaagggacaggaataccg

SEQ ID NO: 222809 - DNA, 25 bp, E. coli
tgattgtgatttgccgacatgttgc

SEQ ID NO: 222810 - DNA, 25 bp, E. coli
tgattgtgatttcccgacatgttgc

SEQ ID NO: 222811 - DNA, 25 bp, E. coli
tcgccgccagccttcatttgatcag

SEQ ID NO: 222812 - DNA, 25 bp, E. coli
tcgccgccagccatcatttgatcag

SEQ ID NO: 222813 - DNA, 25 bp, E. coli
tgccagagtatttcaaagagcgtct

SEQ ID NO: 222814 - DNA, 25 bp, E. coli
tgccagagtattacaaagagcgtct

SEQ ID NO: 222815 - DNA, 25 bp, E. coli
cgcaggctggcaacgaaagcacaaa

SEQ ID NO: 222816 - DNA, 25 bp, E. coli
cccgtgcatcgaaagagcgcaggct

SEQ ID NO: 222817 - DNA, 25 bp, E. coli
cgcaggctggcatcgaaagcacaaa

SEQ ID NO: 222818 - DNA, 25 bp, E. coli
cccgtgcatcgatagagcgcaggct

SEQ ID NO: 222819 - DNA, 25 bp, E. coli
cgggcagcatgttaataagacctca

SEQ ID NO: 222820 - DNA, 25 bp, E. coli
cgggcagcatgtaaataagacctca

SEQ ID NO: 222821 - DNA, 25 bp, E. coli
tatgactcctgatcaggcctgggca

SEQ ID NO: 222822 - DNA, 25 bp, E. coli
tatggatgcaaaaccattacccgct

SEQ ID NO: 222823 - DNA, 25 bp, E. coli
tagcgatatcccgaatttaaccagc

SEQ ID NO: 222824 - DNA, 25 bp, E. coli
tatgactcctgaacaggcctgggca

SEQ ID NO: 222825 - DNA, 25 bp, E. coli
tatggatgcaaatccattacccgct

SEQ ID NO: 222826 - DNA, 25 bp, E. coli
tagcgatatccccaatttaaccagc

SEQ ID NO: 222827 - DNA, 25 bp, E. coli
ttttgctgattaaggcgtaacgacc

SEQ ID NO: 222828 - DNA, 25 bp, E. coli
ttttgctgattatggcgtaacgacc

SEQ ID NO: 222829 - DNA, 25 bp, E. coli
cctgggcaccgtggattgctgagct

SEQ ID NO: 222830 - DNA, 25 bp, E. coli
cctgggcaccgtcgattgctgagct

SEQ ID NO: 222831 - DNA, 25 bp, E. coli
gcatgtggatattatttccccggag

SEQ ID NO: 222832 - DNA, 25 bp, E. coli
gcatgtggatataatttccccggag

SEQ ID NO: 222833 - DNA, 25 bp, E. coli
gttaattcaacacgctgaacgcctg

SEQ ID NO: 222834 - DNA, 25 bp, E. coli
gttaattcaacaggctgaacgcctg

SEQ ID NO: 222835 - DNA, 25 bp, E. coli
ggcttatatcatgttcacctcaggt

SEQ ID NO: 222836 - DNA, 25 bp, E. coli
ggcttatatcatcttcacctcaggt

SEQ ID NO: 222837 - DNA, 25 bp, E. coli
taatggtcggtcagcaggctatcgt

SEQ ID NO: 222838 - DNA, 25 bp, E. coli
taatggtcggtctgcaggctatcgt

SEQ ID NO: 222839 - DNA, 25 bp, E. coli
gagtatcagcagtaccgcgaaagtg

SEQ ID NO: 222840 - DNA, 25 bp, E. coli
gacgctatttgtagccgaacgcacg

SEQ ID NO: 222841 - DNA, 25 bp, E. coli
gagtatcagcagaaccgcgaaagtg

SEQ ID NO: 222842 - DNA, 25 bp, E. coli
gacgctatttgttgccgaacgcacg

SEQ ID NO: 222843 - DNA, 25 bp, E. coli
aagtggctgataaagctaacccgga

SEQ ID NO: 222844 - DNA, 25 bp, E. coli
aagtggctgatatagctaacccgga

SEQ ID NO: 222845 - DNA, 25 bp, E. coli
caagccccggaacaaattatcatgg

SEQ ID NO: 222846 - DNA, 25 bp, E. coli
cacgaagagattcaggcagttgagc

SEQ ID NO: 222847 - DNA, 25 bp, E. coli
cacgaagagattgaggcagttgagc

SEQ ID NO: 222848 - DNA, 25 bp, E. coli
caggtaacgtactgggcattatgca

SEQ ID NO: 222849 - DNA, 25 bp, E. coli
caggtaacgtacagggcattatgca

SEQ ID NO: 222850 - DNA, 25 bp, E. coli
taaaagccgaaaaggaaaacctgcg

SEQ ID NO: 222851 - DNA, 25 bp, E. coli
caagccccggaagaaattatcatgg

SEQ ID NO: 222852 - DNA, 25 bp, E. coli
ttgcgaatctcgtagctcagctggc

SEQ ID NO: 222853 - DNA, 25 bp, E. coli
ttctgctgagcacgtggatccgcgc

SEQ ID NO: 222854 - DNA, 25 bp, E. coli
ttgcgaatctcgaagctcagctggc

SEQ ID NO: 222855 - DNA, 25 bp, E. coli
ttctgctgagcaggtggatccgcgc

SEQ ID NO: 222856 - DNA, 25 bp, E. coli
tgatagcctggatcgtgcgctggaa

SEQ ID NO: 222857 - DNA, 25 bp, E. coli
tgatagcctggaacgtgcgctggaa

SEQ ID NO: 222858 - DNA, 25 bp, E. coli
gaatctgatgaccttgcgccaggta

SEQ ID NO: 222859 - DNA, 25 bp, E. coli
gaatctgatgacgttgcgccaggta

SEQ ID NO: 222860 - DNA, 25 bp, E. coli
gaaaaagcccactaattcgcgctgg

SEQ ID NO: 222861 - DNA, 25 bp, E. coli
gaaaaagcccacaaattcgcgctgg

SEQ ID NO: 222862 - DNA, 25 bp, E. coli
gaaaacctgcgtcgtcgtactgaac

SEQ ID NO: 222863 - DNA, 25 bp, E. coli
gaaaacctgcgtggtcgtactgaac

SEQ ID NO: 222864 - DNA, 25 bp, E. coli
taaaagccgaaatggaaaacctgcg

SEQ ID NO: 222865 - DNA, 25 bp, E. coli
tactggcctgctcccgtgggtgctg

SEQ ID NO: 222866 - DNA, 25 bp, E. coli
tactggcctgctgccgtgggtgctg

SEQ ID NO: 222867 - DNA, 25 bp, E. coli
aatgtaggaggtgcgaatgaacatt

SEQ ID NO: 222868 - DNA, 25 bp, E. coli
agtactggcctgctgccgtgggtgc

SEQ ID NO: 222869 - DNA, 25 bp, E. coli
agtactggcctggtgccgtgggtgc

SEQ ID NO: 222870 - DNA, 25 bp, E. coli
aaatgtaggaggagcgaatgaacat

SEQ ID NO: 222871 - DNA, 25 bp, E. coli
aagtactggcctgctgccgtgggtg

SEQ ID NO: 222872 - DNA, 25 bp, E. coli
aaatgtaggaggtgcgaatgaacat

SEQ ID NO: 222873 - DNA, 25 bp, E. coli
aatgtaggaggtccgaatgaacatt

SEQ ID NO: 222874 - DNA, 25 bp, E. coli
aagtactggcctcctgccgtgggtg

SEQ ID NO: 222875 - DNA, 25 bp, E. coli
tggtggcggcggcaaatgtaggagg

SEQ ID NO: 222876 - DNA, 25 bp, E. coli
gcggtaagtactggcctgctgccgt

SEQ ID NO: 222877 - DNA, 25 bp, E. coli
gcggtaagtactcgcctgctgccgt

SEQ ID NO: 222878 - DNA, 25 bp, E. coli
gaaatgtaggaggtgcgaatgaaca

SEQ ID NO: 222879 - DNA, 25 bp, E. coli
gaaatgtaggagctgcgaatgaaca

SEQ ID NO: 222880 - DNA, 25 bp, E. coli
ctgccgtgggtggtggcgcagtggg

SEQ ID NO: 222881 - DNA, 25 bp, E. coli
ctgccgtgggtgctggcgcagtggg

SEQ ID NO: 222882 - DNA, 25 bp, E. coli
tggcctgctgccctgggtgctggcg

SEQ ID NO: 222883 - DNA, 25 bp, E. coli
tggtggcggcgggaaatgtaggagg

SEQ ID NO: 222884 - DNA, 25 bp, E. coli
tggcctgctgccgtgggtgctggcg

SEQ ID NO: 222885 - DNA, 25 bp, E. coli
taagtactggcctgctgccgtgggt

SEQ ID NO: 222886 - DNA, 25 bp, E. coli
taagtactggccagctgccgtgggt

SEQ ID NO: 222887 - DNA, 25 bp, E. coli
cagaagcaatggttacaaggtagcc

SEQ ID NO: 222888 - DNA, 25 bp, E. coli
cagaagcaatggatacaaggtagcc

SEQ ID NO: 222889 - DNA, 25 bp, E. coli
tacaggagcctttatgcctaacatt

SEQ ID NO: 222890 - DNA, 25 bp, E. coli
tacaggagccttaatgcctaacatt

SEQ ID NO: 222891 - DNA, 25 bp, E. coli
ttgagacttaatcttgccagaagca

SEQ ID NO: 222892 - DNA, 25 bp, E. coli
tagcctcatgcgttattttccctgc

SEQ ID NO: 222893 - DNA, 25 bp, E. coli
tagcctcatgcgatattttccctgc

SEQ ID NO: 222894 - DNA, 25 bp, E. coli
ttgagacttaatgttgccagaagca

SEQ ID NO: 222895 - DNA, 25 bp, E. coli
ttttgtgcgagccatcttccaccct

SEQ ID NO: 222896 - DNA, 25 bp, E. coli
ttttgtgcgagcgatcttccaccct

SEQ ID NO: 222897 - DNA, 25 bp, E. coli
tccaccctttgaaaatttgagactt

SEQ ID NO: 222898 - DNA, 25 bp, E. coli
tccaccctttgataatttgagactt

SEQ ID NO: 222899 - DNA, 25 bp, E. coli
gcgagccatcttgcaccctttgaaa

SEQ ID NO: 222900 - DNA, 25 bp, E. coli
gcgttattttccgtgcttcgaacga

SEQ ID NO: 222901 - DNA, 25 bp, E. coli
gcgagccatcttccaccctttgaaa

SEQ ID NO: 222902 - DNA, 25 bp, E. coli
gcgttattttccctgcttcgaacga

SEQ ID NO: 222903 - DNA, 25 bp, E. coli
cttcgaacgattttacaggagcctt

SEQ ID NO: 222904 - DNA, 25 bp, E. coli
cttcgaacgattatacaggagcctt

SEQ ID NO: 222905 - DNA, 25 bp, E. coli
ggatacaaggtagcctcatgcgtta

SEQ ID NO: 222906 - DNA, 25 bp, E. coli
ggatacaaggtaccctcatgcgtta

SEQ ID NO: 222907 - DNA, 25 bp, E. coli
taatgttgccagtagcaatggatac

SEQ ID NO: 222908 - DNA, 25 bp, E. coli
taatgttgccagaagcaatggatac

SEQ ID NO: 222909 - DNA, 25 bp, E. coli
tgtcagcacattgcttgactgggtg

SEQ ID NO: 222910 - DNA, 25 bp, E. coli
tgtcagcacattccttgactgggtg

SEQ ID NO: 222911 - DNA, 25 bp, E. coli
tgctccggcgcgagtcagcacattg

SEQ ID NO: 222912 - DNA, 25 bp, E. coli
tgctccggcgcgtgtcagcacattg

SEQ ID NO: 222913 - DNA, 25 bp, E. coli
tccggcgcgtgtcagcacattgctt

SEQ ID NO: 222914 - DNA, 25 bp, E. coli
tccggcgcgtgtgagcacattgctt

SEQ ID NO: 222915 - DNA, 25 bp, E. coli
ccggcgcgtgtcagcacattgcttg

SEQ ID NO: 222916 - DNA, 25 bp, E. coli
ccggcgcgtgtctgcacattgcttg

SEQ ID NO: 222917 - DNA, 25 bp, E. coli
gcgcgtgtcagcacattgcttgact

SEQ ID NO: 222918 - DNA, 25 bp, E. coli
gcgtgtcagcactttgcttgactgg

SEQ ID NO: 222919 - DNA, 25 bp, E. coli
gcgtgtcagcacattgcttgactgg

SEQ ID NO: 222920 - DNA, 25 bp, E. coli
gcgcgtgtcagctcattgcttgact

SEQ ID NO: 222921 - DNA, 25 bp, E. coli
cgtgtcagcacattgcttgactggg

SEQ ID NO: 222922 - DNA, 25 bp, E. coli
ctccggcgcgtgacagcacattgct

SEQ ID NO: 222923 - DNA, 25 bp, E. coli
cggcgcgtgtcagcacattgcttga

SEQ ID NO: 222924 - DNA, 25 bp, E. coli
ctccggcgcgtgtcagcacattgct

SEQ ID NO: 222925 - DNA, 25 bp, E. coli
cggcgcgtgtcaccacattgcttga

SEQ ID NO: 222926 - DNA, 25 bp, E. coli
cgtgtcagcacaatgcttgactggg

SEQ ID NO: 222927 - DNA, 25 bp, E. coli
gtcagcacattggttgactgggtgc

SEQ ID NO: 222928 - DNA, 25 bp, E. coli
gtcagcacattgcttgactgggtgc

SEQ ID NO: 222929 - DNA, 25 bp, E. coli
ggcgcgtgtcaggacattgcttgac

SEQ ID NO: 222930 - DNA, 25 bp, E. coli
ggcgcgtgtcagcacattgcttgac

SEQ ID NO: 222931 - DNA, 25 bp, E. coli
cataatgatcgggtttaacggcgtg

SEQ ID NO: 222932 - DNA, 25 bp, E. coli
cataatgatcggctttaacggcgtg

SEQ ID NO: 222933 - DNA, 25 bp, E. coli
catcgtgaaacgacaggctctggac

SEQ ID NO: 222934 - DNA, 25 bp, E. coli
catcgtgaaacgtcaggctctggac

SEQ ID NO: 222935 - DNA, 25 bp, E. coli
tatcgacaaccccaaacgtgaccgg

SEQ ID NO: 222936 - DNA, 25 bp, E. coli
tttcccgctggtcaacaaagagcag

SEQ ID NO: 222937 - DNA, 25 bp, E. coli
tttaacacggtgctgacctacgcga

SEQ ID NO: 222938 - DNA, 25 bp, E. coli
tttaacacggtggtgacctacgcga

SEQ ID NO: 222939 - DNA, 25 bp, E. coli
tttcccgctggtgaacaaagagcag

SEQ ID NO: 222940 - DNA, 25 bp, E. coli
tgatcatcagtcagaagcgcatggg

SEQ ID NO: 222941 - DNA, 25 bp, E. coli
tgatcatcagtctgaagcgcatggg

SEQ ID NO: 222942 - DNA, 25 bp, E. coli
tgcgagcagaccaactttaacacgg

SEQ ID NO: 222943 - DNA, 25 bp, E. coli
tgcgagcagacctactttaacacgg

SEQ ID NO: 222944 - DNA, 25 bp, E. coli
ccatttactggctggaggacacccg

SEQ ID NO: 222945 - DNA, 25 bp, E. coli
ccatttactggcaggaggacacccg

SEQ ID NO: 222946 - DNA, 25 bp, E. coli
gaagatgcaccgcatcacgtcatgg

SEQ ID NO: 222947 - DNA, 25 bp, E. coli
gaagatgcaccggatcacgtcatgg

SEQ ID NO: 222948 - DNA, 25 bp, E. coli
ccgctgctgcaggatgtgaacaaag

SEQ ID NO: 222949 - DNA, 25 bp, E. coli
ccgctgctgcagcatgtgaacaaag

SEQ ID NO: 222950 - DNA, 25 bp, E. coli
taacggcgtgaaccgtgcgaaaacc

SEQ ID NO: 222951 - DNA, 25 bp, E. coli
taacggcgtgaagcgtgcgaaaacc

SEQ ID NO: 222952 - DNA, 25 bp, E. coli
tatcgacaacccgaaacgtgaccgg

SEQ ID NO: 222953 - DNA, 25 bp, E. coli
cactgcacccgcactgatgtacgta

SEQ ID NO: 222954 - DNA, 25 bp, E. coli
cactgcacccgctctgatgtacgta

SEQ ID NO: 222955 - DNA, 25 bp, E. coli
caccgctgtcatttttgatccctgg

SEQ ID NO: 222956 - DNA, 25 bp, E. coli
caccgctgtcatatttgatccctgg

SEQ ID NO: 222957 - DNA, 25 bp, E. coli
catttttgatccgtggttacgccac

SEQ ID NO: 222958 - DNA, 25 bp, E. coli
catttttgatccctggttacgccac

SEQ ID NO: 222959 - DNA, 25 bp, E. coli
acccgctctgatgtacgtaggtttg

SEQ ID NO: 222960 - DNA, 25 bp, E. coli
acccgctctgatctacgtaggtttg

SEQ ID NO: 222961 - DNA, 25 bp, E. coli
acactggtcgtacgccgcgtctttg

SEQ ID NO: 222962 - DNA, 25 bp, E. coli
acactggtcgtaggccgcgtctttg

SEQ ID NO: 222963 - DNA, 25 bp, E. coli
tttgtgacactggtcgtaggccgcg

SEQ ID NO: 222964 - DNA, 25 bp, E. coli
tatcaccgctgtgatttttgatccc

SEQ ID NO: 222965 - DNA, 25 bp, E. coli
tttgtgacactgctcgtaggccgcg

SEQ ID NO: 222966 - DNA, 25 bp, E. coli
tatcaccgctgtcatttttgatccc

SEQ ID NO: 222967 - DNA, 25 bp, E. coli
ttgatccctggtaacgccactgcac

SEQ ID NO: 222968 - DNA, 25 bp, E. coli
ttgatccctggttacgccactgcac

SEQ ID NO: 222969 - DNA, 25 bp, E. coli
tgcacccgctctcatgtacgtaggt

SEQ ID NO: 222970 - DNA, 25 bp, E. coli
tgcacccgctctgatgtacgtaggt

SEQ ID NO: 222971 - DNA, 25 bp, E. coli
gctttgtgacactggtcgtaggccg

SEQ ID NO: 222972 - DNA, 25 bp, E. coli
gctttgtgacacaggtcgtaggccg

SEQ ID NO: 222973 - DNA, 25 bp, E. coli
gtgacactggtcctaggccgcgtct

SEQ ID NO: 222974 - DNA, 25 bp, E. coli
gtgacactggtcgtaggccgcgtct

SEQ ID NO: 222975 - DNA, 25 bp, E. coli
cagttaaagtgggtgataaagaatt

SEQ ID NO: 222976 - DNA, 25 bp, E. coli
cagttaaagtggctgataaagaatt

SEQ ID NO: 222977 - DNA, 25 bp, E. coli
cagtctcttcttctcagtgcgcaaa

SEQ ID NO: 222978 - DNA, 25 bp, E. coli
cagtctcttcttgtcagtgcgcaaa

SEQ ID NO: 222979 - DNA, 25 bp, E. coli
tacaaaatataaagatgacgatacc

SEQ ID NO: 222980 - DNA, 25 bp, E. coli
tacaaaatataatgatgacgatacc

SEQ ID NO: 222981 - DNA, 25 bp, E. coli
aactaatgcctgacataatggaggg

SEQ ID NO: 222982 - DNA, 25 bp, E. coli
aaacattattaaaagctgcatcgct

SEQ ID NO: 222983 - DNA, 25 bp, E. coli
aaacattattaatagctgcatcgct

SEQ ID NO: 222984 - DNA, 25 bp, E. coli
aactaatgcctgtcataatggaggg

SEQ ID NO: 222985 - DNA, 25 bp, E. coli
taccaacagatggaatcttcagtct

SEQ ID NO: 222986 - DNA, 25 bp, E. coli
taccaacagatgcaatcttcagtct

SEQ ID NO: 222987 - DNA, 25 bp, E. coli
ttttcagcaagtccgctggcgacgc

SEQ ID NO: 222988 - DNA, 25 bp, E. coli
ttttcagcaagtgcgctggcgacgc

SEQ ID NO: 222989 - DNA, 25 bp, E. coli
gcgacgcctgatagtgtaactggaa

SEQ ID NO: 222990 - DNA, 25 bp, E. coli
gcgacgcctgattgtgtaactggaa

SEQ ID NO: 222991 - DNA, 25 bp, E. coli
gggatgactgtaaccattaaaacta

SEQ ID NO: 222992 - DNA, 25 bp, E. coli
gggatgactgtatccattaaaacta

SEQ ID NO: 222993 - DNA, 25 bp, E. coli
taactggaaaggaggagtatacaaa

SEQ ID NO: 222994 - DNA, 25 bp, E. coli
taactggaaaggtggagtatacaaa

SEQ ID NO: 222995 - DNA, 25 bp, E. coli
gatgacgatacctttacagttaaag

SEQ ID NO: 222996 - DNA, 25 bp, E. coli
gatgacgataccattacagttaaag

SEQ ID NO: 222997 - DNA, 25 bp, E. coli
catgcactgcaaggcctttgtcggg

SEQ ID NO: 222998 - DNA, 25 bp, E. coli
catgcactgcaacgcctttgtcggg

SEQ ID NO: 222999 - DNA, 25 bp, E. coli
tacagcttttacagccaatgcaacg

SEQ ID NO: 223000 - DNA, 25 bp, E. coli
tacgggaaataaactcgtctggtga

SEQ ID NO: 223001 - DNA, 25 bp, E. coli
tacagcttttactgccaatgcaacg

SEQ ID NO: 223002 - DNA, 25 bp, E. coli
acgggcaagccagcatacagctttt

SEQ ID NO: 223003 - DNA, 25 bp, E. coli
acgggcaagccaccatacagctttt

SEQ ID NO: 223004 - DNA, 25 bp, E. coli
tacgggaaataatctcgtctggtga

SEQ ID NO: 223005 - DNA, 25 bp, E. coli
tttttgcgcgaagaaacgacctcca

SEQ ID NO: 223006 - DNA, 25 bp, E. coli
tttttgcgcgaacaaacgacctcca

SEQ ID NO: 223007 - DNA, 25 bp, E. coli
tgccagcacagatcgcacttaatcg

SEQ ID NO: 223008 - DNA, 25 bp, E. coli
tgccagcacagaacgcacttaatcg

SEQ ID NO: 223009 - DNA, 25 bp, E. coli
gaaaatatgcccatgttcgcggctt

SEQ ID NO: 223010 - DNA, 25 bp, E. coli
gaaaatatgcccttgttcgcggctt

SEQ ID NO: 223011 - DNA, 25 bp, E. coli
ctttgtcgggcacgcttcaacacag

SEQ ID NO: 223012 - DNA, 25 bp, E. coli
cggcttatcgcgtcaacagggcaga

SEQ ID NO: 223013 - DNA, 25 bp, E. coli
ctttgtcgggcaggcttcaacacag

SEQ ID NO: 223014 - DNA, 25 bp, E. coli
cggcttatcgcgacaacagggcaga

SEQ ID NO: 223015 - DNA, 25 bp, E. coli
gtcaacagggcagacattcgcgcac

SEQ ID NO: 223016 - DNA, 25 bp, E. coli
gtcaacagggcacacattcgcgcac

SEQ ID NO: 223017 - DNA, 25 bp, E. coli
tcacactgatgagaggctactgccg

SEQ ID NO: 223018 - DNA, 25 bp, E. coli
tcacactgatgacaggctactgccg

SEQ ID NO: 223019 - DNA, 25 bp, E. coli
aagacagcgttagacaactaatggt

SEQ ID NO: 223020 - DNA, 25 bp, E. coli
cagtggtgatatagtaagcgtaaaa

SEQ ID NO: 223021 - DNA, 25 bp, E. coli
cagtggtgatattgtaagcgtaaaa

SEQ ID NO: 223022 - DNA, 25 bp, E. coli
taaaacatggtgaggtgcaaggaaa

SEQ ID NO: 223023 - DNA, 25 bp, E. coli
taaaacatggtgtggtgcaaggaaa

SEQ ID NO: 223024 - DNA, 25 bp, E. coli
aagacagcgttacacaactaatggt

SEQ ID NO: 223025 - DNA, 25 bp, E. coli
tatgataaacatccgcttttcccca

SEQ ID NO: 223026 - DNA, 25 bp, E. coli
tatgataaacatgcgcttttcccca

SEQ ID NO: 223027 - DNA, 25 bp, E. coli
tttcgtgaagtctcaatcagtggtg

SEQ ID NO: 223028 - DNA, 25 bp, E. coli
tttcgtgaagtcacaatcagtggtg

SEQ ID NO: 223029 - DNA, 25 bp, E. coli
tctcaaagtttgtcggcaataactc

SEQ ID NO: 223030 - DNA, 25 bp, E. coli
tctcaaagtttgacggcaataactc

SEQ ID NO: 223031 - DNA, 25 bp, E. coli
gattgattcgttcccagatgatcca

SEQ ID NO: 223032 - DNA, 25 bp, E. coli
gatacgatcaaacaaaatgcctggc

SEQ ID NO: 223033 - DNA, 25 bp, E. coli
gatcaggctctaggatcaacgaatg

SEQ ID NO: 223034 - DNA, 25 bp, E. coli
gatcaggctctacgatcaacgaatg

SEQ ID NO: 223035 - DNA, 25 bp, E. coli
gattgattcgttgccagatgatcca

SEQ ID NO: 223036 - DNA, 25 bp, E. coli
gatacgatcaaagaaaatgcctggc

SEQ ID NO: 223037 - DNA, 25 bp, E. coli
gatgatccagcgatattgaaatccg

SEQ ID NO: 223038 - DNA, 25 bp, E. coli
gatgatccagcgttattgaaatccg

SEQ ID NO: 223039 - DNA, 25 bp, E. coli
gagcagaatttcttactgacaaaga

SEQ ID NO: 223040 - DNA, 25 bp, E. coli
gagcagaatttcatactgacaaaga

SEQ ID NO: 223041 - DNA, 25 bp, E. coli
tatgcgtgatatttaaagccctttc

SEQ ID NO: 223042 - DNA, 25 bp, E. coli
tatgcgtgatatataaagccctttc

SEQ ID NO: 223043 - DNA, 25 bp, E. coli
tgtccgccattttaatcaagcatac

SEQ ID NO: 223044 - DNA, 25 bp, E. coli
tgtccgccatttaaatcaagcatac

SEQ ID NO: 223045 - DNA, 25 bp, E. coli
tccgacagactgaccgaattgttat

SEQ ID NO: 223046 - DNA, 25 bp, E. coli
tccgacagactgtccgaattgttat

SEQ ID NO: 223047 - DNA, 25 bp, E. coli
tctcttcgtaaatatgataatgcct

SEQ ID NO: 223048 - DNA, 25 bp, E. coli
tctcttcgtaaaaatgataatgcct

SEQ ID NO: 223049 - DNA, 25 bp, E. coli
gaacgagtaattgattgattcaaca

SEQ ID NO: 223050 - DNA, 25 bp, E. coli
gaacgagtaattcattgattcaaca

SEQ ID NO: 223051 - DNA, 25 bp, E. coli
gactatccaatatataaatatgcgt

SEQ ID NO: 223052 - DNA, 25 bp, E. coli
gaacaattggttttaaggagagagt

SEQ ID NO: 223053 - DNA, 25 bp, E. coli
gaacaattggttataaggagagagt

SEQ ID NO: 223054 - DNA, 25 bp, E. coli
gactatccaataaataaatatgcgt

SEQ ID NO: 223055 - DNA, 25 bp, E. coli
gattcaacatcttatgactatccaa

SEQ ID NO: 223056 - DNA, 25 bp, E. coli
gattcaacatctaatgactatccaa

SEQ ID NO: 223057 - DNA, 25 bp, E. coli
ggaattttcttgtctctccgacaga

SEQ ID NO: 223058 - DNA, 25 bp, E. coli
ggaattttcttgactctccgacaga

SEQ ID NO: 223059 - DNA, 25 bp, E. coli
taataataacaaaaattgtccgcca

SEQ ID NO: 223060 - DNA, 25 bp, E. coli
taataataacaataattgtccgcca

SEQ ID NO: 223061 - DNA, 25 bp, E. coli
tcaagcatactaaatccaataagtg

SEQ ID NO: 223062 - DNA, 25 bp, E. coli
tcaagcatactatatccaataagtg

SEQ ID NO: 223063 - DNA, 25 bp, E. coli
tacacctgtttattttttcatcact

SEQ ID NO: 223064 - DNA, 25 bp, E. coli
tacacctgtttaatttttcatcact

SEQ ID NO: 223065 - DNA, 25 bp, E. coli
taccggacagatcacgtacttacac

SEQ ID NO: 223066 - DNA, 25 bp, E. coli
taccggacagatgacgtacttacac

SEQ ID NO: 223067 - DNA, 25 bp, E. coli
tcgttccggtgacaactggcagtct

SEQ ID NO: 223068 - DNA, 25 bp, E. coli
tcgttccggtgagaactggcagtct

SEQ ID NO: 223069 - DNA, 25 bp, E. coli
tcttagggggcttaccggacagatg

SEQ ID NO: 223070 - DNA, 25 bp, E. coli
tcatcacttattcggatgaacaccc

SEQ ID NO: 223071 - DNA, 25 bp, E. coli
tcttagggggctaaccggacagatg

SEQ ID NO: 223072 - DNA, 25 bp, E. coli
tcatcacttattgggatgaacaccc

SEQ ID NO: 223073 - DNA, 25 bp, E. coli
ggtgacaactggcagtcttcgttta

SEQ ID NO: 223074 - DNA, 25 bp, E. coli
ggcaaatcatctttaattatgactc

SEQ ID NO: 223075 - DNA, 25 bp, E. coli
ggtgacaactgggagtcttcgttta

SEQ ID NO: 223076 - DNA, 25 bp, E. coli
gggatgaacaccgataaccattttg

SEQ ID NO: 223077 - DNA, 25 bp, E. coli
gggatgaacacccataaccattttg

SEQ ID NO: 223078 - DNA, 25 bp, E. coli
ggcaaagaggccatcgttccggtga

SEQ ID NO: 223079 - DNA, 25 bp, E. coli
ggcaaagaggccttcgttccggtga

SEQ ID NO: 223080 - DNA, 25 bp, E. coli
ggcaaatcatctataattatgactc

SEQ ID NO: 223081 - DNA, 25 bp, E. coli
gaggccatcgttccggtgacaactg

SEQ ID NO: 223082 - DNA, 25 bp, E. coli
gatgacgtactttcacctgtttaat

SEQ ID NO: 223083 - DNA, 25 bp, E. coli
gatgacgtacttacacctgtttaat

SEQ ID NO: 223084 - DNA, 25 bp, E. coli
gaggccatcgttgcggtgacaactg

SEQ ID NO: 223085 - DNA, 25 bp, E. coli
cagacacactccccgggacaacact

SEQ ID NO: 223086 - DNA, 25 bp, E. coli
cagacacactccgcgggacaacact

SEQ ID NO: 223087 - DNA, 25 bp, E. coli
cagaggcctgttgagcgatgcagat

SEQ ID NO: 223088 - DNA, 25 bp, E. coli
cagaggcctgttcagcgatgcagat

SEQ ID NO: 223089 - DNA, 25 bp, E. coli
atcagaggcctgatcagcgatgcag

SEQ ID NO: 223090 - DNA, 25 bp, E. coli
atcagaggcctgttcagcgatgcag

SEQ ID NO: 223091 - DNA, 25 bp, E. coli
ttcagcgatgcagatgcgtaccacc

SEQ ID NO: 223092 - DNA, 25 bp, E. coli
tatcagaggcctcttcagcgatgca

SEQ ID NO: 223093 - DNA, 25 bp, E. coli
tatcagaggcctgttcagcgatgca

SEQ ID NO: 223094 - DNA, 25 bp, E. coli
ttcagcgatgcacatgcgtaccacc

SEQ ID NO: 223095 - DNA, 25 bp, E. coli
tgttcagcgatggagatgcgtacca

SEQ ID NO: 223096 - DNA, 25 bp, E. coli
tgttcagcgatgcagatgcgtacca

SEQ ID NO: 223097 - DNA, 25 bp, E. coli
tcagaggcctgttcagcgatgcaga

SEQ ID NO: 223098 - DNA, 25 bp, E. coli
gcctgttcagcgttgcagatgcgta

SEQ ID NO: 223099 - DNA, 25 bp, E. coli
cctgttcagcgatgcagatgcgtac

SEQ ID NO: 223100 - DNA, 25 bp, E. coli
gcctgttcagcgatgcagatgcgta

SEQ ID NO: 223101 - DNA, 25 bp, E. coli
cctgttcagcgaagcagatgcgtac

SEQ ID NO: 223102 - DNA, 25 bp, E. coli
ggcctgttcagcgatgcagatgcgt

SEQ ID NO: 223103 - DNA, 25 bp, E. coli
ggcctgttcagccatgcagatgcgt

SEQ ID NO: 223104 - DNA, 25 bp, E. coli
tcagaggcctgtacagcgatgcaga

SEQ ID NO: 223105 - DNA, 25 bp, E. coli
gaggcctgttcaccgatgcagatgc

SEQ ID NO: 223106 - DNA, 25 bp, E. coli
gaggcctgttcagcgatgcagatgc

SEQ ID NO: 223107 - DNA, 25 bp, E. coli
aacgttcacgccagacattcctcta

SEQ ID NO: 223108 - DNA, 25 bp, E. coli
ctcaggagaccacgctcaacgaact

SEQ ID NO: 223109 - DNA, 25 bp, E. coli
ctcaggagaccaggctcaacgaact

SEQ ID NO: 223110 - DNA, 25 bp, E. coli
cgggcgcggtaatcgttcacgcctg

SEQ ID NO: 223111 - DNA, 25 bp, E. coli
cgggcgcggtaaacgttcacgcctg

SEQ ID NO: 223112 - DNA, 25 bp, E. coli
aggagttccccttttatgccatctg

SEQ ID NO: 223113 - DNA, 25 bp, E. coli
aggagttcccctattatgccatctg

SEQ ID NO: 223114 - DNA, 25 bp, E. coli
aaatctcaggagtccacgctcaacg

SEQ ID NO: 223115 - DNA, 25 bp, E. coli
aacgttcacgcctgacattcctcta

SEQ ID NO: 223116 - DNA, 25 bp, E. coli
aaatctcaggagaccacgctcaacg

SEQ ID NO: 223117 - DNA, 25 bp, E. coli
cgcggtaaacgttcacgcctgacat

SEQ ID NO: 223118 - DNA, 25 bp, E. coli
cgcggtaaacgtacacgcctgacat

SEQ ID NO: 223119 - DNA, 25 bp, E. coli
ctgcgagggtaattctcaggagacc

SEQ ID NO: 223120 - DNA, 25 bp, E. coli
ctgcgagggtaaatctcaggagacc

SEQ ID NO: 223121 - DNA, 25 bp, E. coli
gttccccttttatgccatctgctcg

SEQ ID NO: 223122 - DNA, 25 bp, E. coli
gttccccttttaagccatctgctcg

SEQ ID NO: 223123 - DNA, 25 bp, E. coli
ggtaaatctcagcagaccacgctca

SEQ ID NO: 223124 - DNA, 25 bp, E. coli
ggtaaacgttcacgcctgacattcc

SEQ ID NO: 223125 - DNA, 25 bp, E. coli
ggtaaatctcaggagaccacgctca

SEQ ID NO: 223126 - DNA, 25 bp, E. coli
ggtaaacgttcaggcctgacattcc

SEQ ID NO: 223127 - DNA, 25 bp, E. coli
gagggtaaatctgaggagaccacgc

SEQ ID NO: 223128 - DNA, 25 bp, E. coli
gagggtaaatctcaggagaccacgc

SEQ ID NO: 223129 - DNA, 25 bp, E. coli
aatcaatgtggagttttctgccgtg

SEQ ID NO: 223130 - DNA, 25 bp, E. coli
aatcaatgtggacttttctgccgtg

SEQ ID NO: 223131 - DNA, 25 bp, E. coli
ttgggttagcgacaagagccagtaa

SEQ ID NO: 223132 - DNA, 25 bp, E. coli
ttgggttagcgagaagagccagtaa

SEQ ID NO: 223133 - DNA, 25 bp, E. coli
tatggcatagcatagtgtgacgccg

SEQ ID NO: 223134 - DNA, 25 bp, E. coli
tatggagaaacactagagagttgcg

SEQ ID NO: 223135 - DNA, 25 bp, E. coli
tatggcatagcaaagtgtgacgccg

SEQ ID NO: 223136 - DNA, 25 bp, E. coli
tatggagaaacagtagagagttgcg

SEQ ID NO: 223137 - DNA, 25 bp, E. coli
tgtgacgccgtgcaaataatcaatg

SEQ ID NO: 223138 - DNA, 25 bp, E. coli
tgtgacgccgtggaaataatcaatg

SEQ ID NO: 223139 - DNA, 25 bp, E. coli
gctttggtcccggtttgttacagaa

SEQ ID NO: 223140 - DNA, 25 bp, E. coli
gctttggtcccgctttgttacagaa

SEQ ID NO: 223141 - DNA, 25 bp, E. coli
gcagtgacggcattgtctgatgcaa

SEQ ID NO: 223142 - DNA, 25 bp, E. coli
gcagtgacggcaatgtctgatgcaa

SEQ ID NO: 223143 - DNA, 25 bp, E. coli
gacaattggtttgttctctgaatgg

SEQ ID NO: 223144 - DNA, 25 bp, E. coli
gacaattggtttcttctctgaatgg

SEQ ID NO: 223145 - DNA, 25 bp, E. coli
cgtcaggtaggatccgctaatctta

SEQ ID NO: 223146 - DNA, 25 bp, E. coli
cgtcaggtaggaaccgctaatctta

SEQ ID NO: 223147 - DNA, 25 bp, E. coli
gagttgcgataataagcgtcaggta

SEQ ID NO: 223148 - DNA, 25 bp, E. coli
gagccagtaaaagacgcagtgacgg

SEQ ID NO: 223149 - DNA, 25 bp, E. coli
gagttgcgataaaaagcgtcaggta

SEQ ID NO: 223150 - DNA, 25 bp, E. coli
gagccagtaaaacacgcagtgacgg

SEQ ID NO: 223151 - DNA, 25 bp, E. coli
catgatgataaaaaccgcttacgca

SEQ ID NO: 223152 - DNA, 25 bp, E. coli
catgatgataaataccgcttacgca

SEQ ID NO: 223153 - DNA, 25 bp, E. coli
taaataccgcttacgcaacagatga

SEQ ID NO: 223154 - DNA, 25 bp, E. coli
tacgcaacagatcaagcgaaagccg

SEQ ID NO: 223155 - DNA, 25 bp, E. coli
taaaatttactaccgcgcgaatgat

SEQ ID NO: 223156 - DNA, 25 bp, E. coli
taaataccgctttcgcaacagatga

SEQ ID NO: 223157 - DNA, 25 bp, E. coli
taaaatttactagcgcgcgaatgat

SEQ ID NO: 223158 - DNA, 25 bp, E. coli
tacgcaacagatgaagcgaaagccg

SEQ ID NO: 223159 - DNA, 25 bp, E. coli
aaacccattattgccgttatctata

SEQ ID NO: 223160 - DNA, 25 bp, E. coli
aaacccattattcccgttatctata

SEQ ID NO: 223161 - DNA, 25 bp, E. coli
ttattgacccacaggtgacgccacc

SEQ ID NO: 223162 - DNA, 25 bp, E. coli
ttattgacccactggtgacgccacc

SEQ ID NO: 223163 - DNA, 25 bp, E. coli
tattgccgttatctatacccacagc

SEQ ID NO: 223164 - DNA, 25 bp, E. coli
tattgccgttatgtatacccacagc

SEQ ID NO: 223165 - DNA, 25 bp, E. coli
tgttattgaccctctggtgacgcca

SEQ ID NO: 223166 - DNA, 25 bp, E. coli
tgttattgacccactggtgacgcca

SEQ ID NO: 223167 - DNA, 25 bp, E. coli
gcatcgcccgcaaaaacccattatt

SEQ ID NO: 223168 - DNA, 25 bp, E. coli
gcatcgcccgcataaacccattatt

SEQ ID NO: 223169 - DNA, 25 bp, E. coli
cgcaacagatgaagcgaaagccgcc

SEQ ID NO: 223170 - DNA, 25 bp, E. coli
cgcaacagatgatgcgaaagccgcc

SEQ ID NO: 223171 - DNA, 25 bp, E. coli
ggtaaaatttacaaccgcgcgaatg

SEQ ID NO: 223172 - DNA, 25 bp, E. coli
ggtaaaatttactaccgcgcgaatg

SEQ ID NO: 223173 - DNA, 25 bp, E. coli
aagaatttgcgcaggcttaccccga

SEQ ID NO: 223174 - DNA, 25 bp, E. coli
aagaatttgcgctggcttaccccga

SEQ ID NO: 223175 - DNA, 25 bp, E. coli
cactgtacgactcgaccgaaagcga

SEQ ID NO: 223176 - DNA, 25 bp, E. coli
cactgtacgactggaccgaaagcga

SEQ ID NO: 223177 - DNA, 25 bp, E. coli
actacccggcgtcgtttgaagcagg

SEQ ID NO: 223178 - DNA, 25 bp, E. coli
actacccggcgtggtttgaagcagg

SEQ ID NO: 223179 - DNA, 25 bp, E. coli
ttaatcttgatatacccggcgcacg

SEQ ID NO: 223180 - DNA, 25 bp, E. coli
ttaatcttgataaacccggcgcacg

SEQ ID NO: 223181 - DNA, 25 bp, E. coli
tgatatcacgctgcatccgctggcg

SEQ ID NO: 223182 - DNA, 25 bp, E. coli
tgatatcacgctccatccgctggcg

SEQ ID NO: 223183 - DNA, 25 bp, E. coli
tgaaactgtatagcgaagatgccgc

SEQ ID NO: 223184 - DNA, 25 bp, E. coli
tgaaactgtataccgaagatgccgc

SEQ ID NO: 223185 - DNA, 25 bp, E. coli
gaaaacgaatttctgctgcgcccga

SEQ ID NO: 223186 - DNA, 25 bp, E. coli
gaaaacgaatttgtgctgcgcccga

SEQ ID NO: 223187 - DNA, 25 bp, E. coli
cattgcaatatgtaccggacggacg

SEQ ID NO: 223188 - DNA, 25 bp, E. coli
cattgcaatatgaaccggacggacg

SEQ ID NO: 223189 - DNA, 25 bp, E. coli
gattgtcgacgtacagcacagcctg

SEQ ID NO: 223190 - DNA, 25 bp, E. coli
gattgtcgacgttcagcacagcctg

SEQ ID NO: 223191 - DNA, 25 bp, E. coli
ggcccctgcgggactgtcaaaaaat

SEQ ID NO: 223192 - DNA, 25 bp, E. coli
ggcccctgcgggtctgtcaaaaaat

SEQ ID NO: 223193 - DNA, 25 bp, E. coli
gagaacgtcatctggccggaaagga

SEQ ID NO: 223194 - DNA, 25 bp, E. coli
gagaacgtcatcaggccggaaagga

SEQ ID NO: 223195 - DNA, 25 bp, E. coli
aatagagcaaacatacgggatgccg

SEQ ID NO: 223196 - DNA, 25 bp, E. coli
aatagagcaaacttacgggatgccg

SEQ ID NO: 223197 - DNA, 25 bp, E. coli
cagccttccctgtggatgagcaacg

SEQ ID NO: 223198 - DNA, 25 bp, E. coli
cagccttccctgaggatgagcaacg

SEQ ID NO: 223199 - DNA, 25 bp, E. coli
cagggttaacgtctaatcaactgga

SEQ ID NO: 223200 - DNA, 25 bp, E. coli
cagggttaacgtgtaatcaactgga

SEQ ID NO: 223201 - DNA, 25 bp, E. coli
tatctggatgcgcaatacgcagaac

SEQ ID NO: 223202 - DNA, 25 bp, E. coli
tatctggatgcggaatacgcagaac

SEQ ID NO: 223203 - DNA, 25 bp, E. coli
tgagcaacgccacataatcagcgag

SEQ ID NO: 223204 - DNA, 25 bp, E. coli
tgagcaacgccagataatcagcgag

SEQ ID NO: 223205 - DNA, 25 bp, E. coli
tctgccacccaatgagaagagctac

SEQ ID NO: 223206 - DNA, 25 bp, E. coli
tctgccacccaaagagaagagctac

SEQ ID NO: 223207 - DNA, 25 bp, E. coli
tctcatagcgagatggattgcggcg

SEQ ID NO: 223208 - DNA, 25 bp, E. coli
tctcatagcgagttggattgcggcg

SEQ ID NO: 223209 - DNA, 25 bp, E. coli
cctcgtttggagaaaaggctgccag

SEQ ID NO: 223210 - DNA, 25 bp, E. coli
cctcgtttggagtaaaggctgccag

SEQ ID NO: 223211 - DNA, 25 bp, E. coli
gaaattcgccgtatacgtctcaagg

SEQ ID NO: 223212 - DNA, 25 bp, E. coli
gaaattcgccgtttacgtctcaagg

SEQ ID NO: 223213 - DNA, 25 bp, E. coli
gggttctccacctcatgcagggtta

SEQ ID NO: 223214 - DNA, 25 bp, E. coli
gggttctccaccacatgcagggtta

SEQ ID NO: 223215 - DNA, 25 bp, E. coli
tcaactaatgagtgggagagcctcg

SEQ ID NO: 223216 - DNA, 25 bp, E. coli
tcaactaatgagagggagagcctcg

SEQ ID NO: 223217 - DNA, 25 bp, E. coli
cagggcgttgatgatctgaaccagc

SEQ ID NO: 223218 - DNA, 25 bp, E. coli
cagggcgttgatcatctgaaccagc

SEQ ID NO: 223219 - DNA, 25 bp, E. coli
tccgacccgaaaatccttgccgaat

SEQ ID NO: 223220 - DNA, 25 bp, E. coli
tccgacccgaaattccttgccgaat

SEQ ID NO: 223221 - DNA, 25 bp, E. coli
tctgaaccagcatgttgaaaaagcg

SEQ ID NO: 223222 - DNA, 25 bp, E. coli
tctgaaccagcaagttgaaaaagcg

SEQ ID NO: 223223 - DNA, 25 bp, E. coli
gccgaatatcaatgtgcattagctg

SEQ ID NO: 223224 - DNA, 25 bp, E. coli
gccgaatatcaaagtgcattagctg

SEQ ID NO: 223225 - DNA, 25 bp, E. coli
gcgttggaggatttagcaaccaatc

SEQ ID NO: 223226 - DNA, 25 bp, E. coli
gcgttggaggatatagcaaccaatc

SEQ ID NO: 223227 - DNA, 25 bp, E. coli
gcgtataaagatcttgattcggcaa

SEQ ID NO: 223228 - DNA, 25 bp, E. coli
gcgtataaagatgttgattcggcaa

SEQ ID NO: 223229 - DNA, 25 bp, E. coli
gcaaacaatttgttcagggcgttga

SEQ ID NO: 223230 - DNA, 25 bp, E. coli
gcaaacaatttgatcagggcgttga

SEQ ID NO: 223231 - DNA, 25 bp, E. coli
cgaaatgcgcaaactaacgttgtaa

SEQ ID NO: 223232 - DNA, 25 bp, E. coli
cgaaatgcgcaatctaacgttgtaa

SEQ ID NO: 223233 - DNA, 25 bp, E. coli
ggttatattatggacatcagcaaac

SEQ ID NO: 223234 - DNA, 25 bp, E. coli
ggttatattatgcacatcagcaaac

SEQ ID NO: 223235 - DNA, 25 bp, E. coli
ggcaatcatacataacttccgctaa

SEQ ID NO: 223236 - DNA, 25 bp, E. coli
ggcaatcatacaaaacttccgctaa

SEQ ID NO: 223237 - DNA, 25 bp, E. coli
gagtatacattatatcgaaatgcgc

SEQ ID NO: 223238 - DNA, 25 bp, E. coli
gagtatacattaaatcgaaatgcgc

SEQ ID NO: 223239 - DNA, 25 bp, E. coli
cgtgtgcgtgaaccctggcgactca

SEQ ID NO: 223240 - DNA, 25 bp, E. coli
cgtgtgcgtgaagcctggcgactca

SEQ ID NO: 223241 - DNA, 25 bp, E. coli
taaaaccgatatggtagtcagcggc

SEQ ID NO: 223242 - DNA, 25 bp, E. coli
taaaaccgatatcgtagtcagcggc

SEQ ID NO: 223243 - DNA, 25 bp, E. coli
aaccgctatcgcctgagacacatgg

SEQ ID NO: 223244 - DNA, 25 bp, E. coli
aaccgctatcgcgtgagacacatgg

SEQ ID NO: 223245 - DNA, 25 bp, E. coli
tagttttctactcgcgccgctacaa

SEQ ID NO: 223246 - DNA, 25 bp, E. coli
tagttttctactggcgccgctacaa

SEQ ID NO: 223247 - DNA, 25 bp, E. coli
tattgtcgggatccgcttgtatggc

SEQ ID NO: 223248 - DNA, 25 bp, E. coli
tattgtcgggatgcgcttgtatggc

SEQ ID NO: 223249 - DNA, 25 bp, E. coli
ttctggaagcgcaggaggagatccc

SEQ ID NO: 223250 - DNA, 25 bp, E. coli
ttctggaagcgctggaggagatccc

SEQ ID NO: 223251 - DNA, 25 bp, E. coli
tgttaacggcgtgattctggaagcg

SEQ ID NO: 223252 - DNA, 25 bp, E. coli
tgttaacggcgtcattctggaagcg

SEQ ID NO: 223253 - DNA, 25 bp, E. coli
gctacaagtcctgatgatgccgcta

SEQ ID NO: 223254 - DNA, 25 bp, E. coli
gctacaagtcctcatgatgccgcta

SEQ ID NO: 223255 - DNA, 25 bp, E. coli
gcaaggtaatcggtcggcaaaacgc

SEQ ID NO: 223256 - DNA, 25 bp, E. coli
gcaaggtaatcgctcggcaaaacgc

SEQ ID NO: 223257 - DNA, 25 bp, E. coli
tcaatatccttggttccgcactcgg

SEQ ID NO: 223258 - DNA, 25 bp, E. coli
tcaatatccttgcttccgcactcgg

SEQ ID NO: 223259 - DNA, 25 bp, E. coli
gatgatgctcgtactgttaacggcg

SEQ ID NO: 223260 - DNA, 25 bp, E. coli
gatgatgctcgttctgttaacggcg

SEQ ID NO: 223261 - DNA, 25 bp, E. coli
tactctagtaaagagataacgacag

SEQ ID NO: 223262 - DNA, 25 bp, E. coli
tactctagtaaacagataacgacag

SEQ ID NO: 223263 - DNA, 25 bp, E. coli
caataaagcgacattaaggtattcg

SEQ ID NO: 223264 - DNA, 25 bp, E. coli
caataaagcgactttaaggtattcg

SEQ ID NO: 223265 - DNA, 25 bp, E. coli
tataagttgtcgcatttaattacac

SEQ ID NO: 223266 - DNA, 25 bp, E. coli
tataagttgtcggatttaattacac

SEQ ID NO: 223267 - DNA, 25 bp, E. coli
ttattgccattgttccgaaaaccga

SEQ ID NO: 223268 - DNA, 25 bp, E. coli
ttattgccattgatccgaaaaccga

SEQ ID NO: 223269 - DNA, 25 bp, E. coli
tgtagcgacgaagaacggtgtgcca

SEQ ID NO: 223270 - DNA, 25 bp, E. coli
tgtagcgacgaacaacggtgtgcca

SEQ ID NO: 223271 - DNA, 25 bp, E. coli
tgccaggtttattctcgcccatgcg

SEQ ID NO: 223272 - DNA, 25 bp, E. coli
tgccaggtttatactcgcccatgcg

SEQ ID NO: 223273 - DNA, 25 bp, E. coli
gcgtagcccctatgaaatgaatgtc

SEQ ID NO: 223274 - DNA, 25 bp, E. coli
gcgtagcccctaagaaatgaatgtc

SEQ ID NO: 223275 - DNA, 25 bp, E. coli
gaaaaacttggatataatcgcgcga

SEQ ID NO: 223276 - DNA, 25 bp, E. coli
gaaaaacttggaaataatcgcgcga

SEQ ID NO: 223277 - DNA, 25 bp, E. coli
cgatggtggatgaattgctgtgcta

SEQ ID NO: 223278 - DNA, 25 bp, E. coli
cgatggtggatgtattgctgtgcta

SEQ ID NO: 223279 - DNA, 25 bp, E. coli
gttgcccgaaaaggaaatattagcg

SEQ ID NO: 223280 - DNA, 25 bp, E. coli
gttgcccgaaaacgaaatattagcg

SEQ ID NO: 223281 - DNA, 25 bp, E. coli
taacgacagaactgaacaataaagc

SEQ ID NO: 223282 - DNA, 25 bp, E. coli
taacgacagaacagaacaataaagc

SEQ ID NO: 223283 - DNA, 25 bp, E. coli
agcaatctccggctggctgcgtgat

SEQ ID NO: 223284 - DNA, 25 bp, E. coli
agcaatctccgggtggctgcgtgat

SEQ ID NO: 223285 - DNA, 25 bp, E. coli
tatatcaaccatgtggagaagcgcc

SEQ ID NO: 223286 - DNA, 25 bp, E. coli
tatatcaaccatctggagaagcgcc

SEQ ID NO: 223287 - DNA, 25 bp, E. coli
tgattaccattgaggccaccagcga

SEQ ID NO: 223288 - DNA, 25 bp, E. coli
tgattaccattgtggccaccagcga

SEQ ID NO: 223289 - DNA, 25 bp, E. coli
tactggatattcacccgaacaaggg

SEQ ID NO: 223290 - DNA, 25 bp, E. coli
tactggatattctcccgaacaaggg

SEQ ID NO: 223291 - DNA, 25 bp, E. coli
gccggagcgcctttgtgaacaatta

SEQ ID NO: 223292 - DNA, 25 bp, E. coli
ccttactggcgggagtgaaaccaat

SEQ ID NO: 223293 - DNA, 25 bp, E. coli
gccggagcgcctatgtgaacaatta

SEQ ID NO: 223294 - DNA, 25 bp, E. coli
ccttactggcggcagtgaaaccaat

SEQ ID NO: 223295 - DNA, 25 bp, E. coli
gcgggactcgcagaacctgaataaa

SEQ ID NO: 223296 - DNA, 25 bp, E. coli
gcgggactcgcacaacctgaataaa

SEQ ID NO: 223297 - DNA, 25 bp, E. coli
cctaaagcatatagtgggccacacc

SEQ ID NO: 223298 - DNA, 25 bp, E. coli
cctaaagcatattgtgggccacacc

SEQ ID NO: 223299 - DNA, 25 bp, E. coli
gttttatcgccctgagcacggcaca

SEQ ID NO: 223300 - DNA, 25 bp, E. coli
gttttatcgcccagagcacggcaca

SEQ ID NO: 223301 - DNA, 25 bp, E. coli
gtgcataaatgcaaagccccgcaag

SEQ ID NO: 223302 - DNA, 25 bp, E. coli
gtgcataaatgctaagccccgcaag

SEQ ID NO: 223303 - DNA, 25 bp, E. coli
gagaagcgccacaattgccgaataa

SEQ ID NO: 223304 - DNA, 25 bp, E. coli
gagaagcgccactattgccgaataa

SEQ ID NO: 223305 - DNA, 25 bp, E. coli
cagctttaaaaacactcggtgttgt

SEQ ID NO: 223306 - DNA, 25 bp, E. coli
cagctttaaaaagactcggtgttgt

SEQ ID NO: 223307 - DNA, 25 bp, E. coli
tattggaaaacctgttcgtttcaga

SEQ ID NO: 223308 - DNA, 25 bp, E. coli
tattggaaaaccagttcgtttcaga

SEQ ID NO: 223309 - DNA, 25 bp, E. coli
tgatgctgataaacgggttcagttt

SEQ ID NO: 223310 - DNA, 25 bp, E. coli
tgttagtggttgatgctgataatcg

SEQ ID NO: 223311 - DNA, 25 bp, E. coli
tgatgctgataatcgggttcagttt

SEQ ID NO: 223312 - DNA, 25 bp, E. coli
tgttagtggttgttgctgataatcg

SEQ ID NO: 223313 - DNA, 25 bp, E. coli
tcagacagctttaaaaacactcggt

SEQ ID NO: 223314 - DNA, 25 bp, E. coli
gaaaacctgttcgtttcagaccatt

SEQ ID NO: 223315 - DNA, 25 bp, E. coli
gaaaacctgttcctttcagaccatt

SEQ ID NO: 223316 - DNA, 25 bp, E. coli
gacagctttaaaaacactcggtgtt

SEQ ID NO: 223317 - DNA, 25 bp, E. coli
gacagctttaaatacactcggtgtt

SEQ ID NO: 223318 - DNA, 25 bp, E. coli
tggaaaacctgtacgtttcagacca

SEQ ID NO: 223319 - DNA, 25 bp, E. coli
tggttgatgctgttaatcgggttca

SEQ ID NO: 223320 - DNA, 25 bp, E. coli
tggttgatgctgataatcgggttca

SEQ ID NO: 223321 - DNA, 25 bp, E. coli
tggaaaacctgttcgtttcagacca

SEQ ID NO: 223322 - DNA, 25 bp, E. coli
taatattattggtaaacctgttcgt

SEQ ID NO: 223323 - DNA, 25 bp, E. coli
tcagacagcttttaaaacactcggt

SEQ ID NO: 223324 - DNA, 25 bp, E. coli
taatcagacagctttaaaaacactc

SEQ ID NO: 223325 - DNA, 25 bp, E. coli
taatattattggaaaacctgttcgt

SEQ ID NO: 223326 - DNA, 25 bp, E. coli
taatcagacagcattaaaaacactc

SEQ ID NO: 223327 - DNA, 25 bp, E. coli
agaaattctgcgaactaacctggcc

SEQ ID NO: 223328 - DNA, 25 bp, E. coli
agaaattctgcgtactaacctggcc

SEQ ID NO: 223329 - DNA, 25 bp, E. coli
gctgcatgaaaatgtccgcgctgaa

SEQ ID NO: 223330 - DNA, 25 bp, E. coli
gctgcatgaaaaagtccgcgctgaa

SEQ ID NO: 223331 - DNA, 25 bp, E. coli
gaagggcgctcattacaggatctga

SEQ ID NO: 223332 - DNA, 25 bp, E. coli
gaagggcgctcaatacaggatctga

SEQ ID NO: 223333 - DNA, 25 bp, E. coli
gacacgttacggaatttgcaggcga

SEQ ID NO: 223334 - DNA, 25 bp, E. coli
gaactggaacactaaactcgtcgcc

SEQ ID NO: 223335 - DNA, 25 bp, E. coli
gacacgttacggtatttgcaggcga

SEQ ID NO: 223336 - DNA, 25 bp, E. coli
gaactggaacacaaaactcgtcgcc

SEQ ID NO: 223337 - DNA, 25 bp, E. coli
cccgcgtgagcgaccgatggataaa

SEQ ID NO: 223338 - DNA, 25 bp, E. coli
cccgcgtgagcgtccgatggataaa

SEQ ID NO: 223339 - DNA, 25 bp, E. coli
gattgatccgcaacgtgaccgtgct

SEQ ID NO: 223340 - DNA, 25 bp, E. coli
gattgatccgcatcgtgaccgtgct

SEQ ID NO: 223341 - DNA, 25 bp, E. coli
ggatctgaaagaggccctgaaaggc

SEQ ID NO: 223342 - DNA, 25 bp, E. coli
gtcgagcaaatcgtcactgcggtgt

SEQ ID NO: 223343 - DNA, 25 bp, E. coli
gtcgagcaaatcctcactgcggtgt

SEQ ID NO: 223344 - DNA, 25 bp, E. coli
ggatctgaaagacgccctgaaaggc

SEQ ID NO: 223345 - DNA, 25 bp, E. coli
tcagccacgatgtgatttccgcacg

SEQ ID NO: 223346 - DNA, 25 bp, E. coli
tcagccacgatgagatttccgcacg

SEQ ID NO: 223347 - DNA, 25 bp, E. coli
gatgaactgagccaggaaagccctg

SEQ ID NO: 223348 - DNA, 25 bp, E. coli
gatgaactgagcgaggaaagccctg

SEQ ID NO: 223349 - DNA, 25 bp, E. coli
cacgccggctgacctgtcatcgtta

SEQ ID NO: 223350 - DNA, 25 bp, E. coli
cacgccggctgagctgtcatcgtta

SEQ ID NO: 223351 - DNA, 25 bp, E. coli
caggagggcaatcagttgcattacc

SEQ ID NO: 223352 - DNA, 25 bp, E. coli
caggagggcaatgagttgcattacc

SEQ ID NO: 223353 - DNA, 25 bp, E. coli
taaactatcattgaccgattttctg

SEQ ID NO: 223354 - DNA, 25 bp, E. coli
attatcccgacgacaacaacgaccg

SEQ ID NO: 223355 - DNA, 25 bp, E. coli
attatcccgacgtcaacaacgaccg

SEQ ID NO: 223356 - DNA, 25 bp, E. coli
tcgtgtcagacaggctccatgaaac

SEQ ID NO: 223357 - DNA, 25 bp, E. coli
tcgtgtcagacacgctccatgaaac

SEQ ID NO: 223358 - DNA, 25 bp, E. coli
ccggctgacctgacatcgttaaact

SEQ ID NO: 223359 - DNA, 25 bp, E. coli
ccggctgacctgtcatcgttaaact

SEQ ID NO: 223360 - DNA, 25 bp, E. coli
gctgacctgtcaacgttaaactatc

SEQ ID NO: 223361 - DNA, 25 bp, E. coli
gctgacctgtcatcgttaaactatc

SEQ ID NO: 223362 - DNA, 25 bp, E. coli
cgccggctgaccagtcatcgttaaa

SEQ ID NO: 223363 - DNA, 25 bp, E. coli
cgccggctgacctgtcatcgttaaa

SEQ ID NO: 223364 - DNA, 25 bp, E. coli
cattcaccgattatctgtgaggact

SEQ ID NO: 223365 - DNA, 25 bp, E. coli
cattcaccgattttctgtgaggact

SEQ ID NO: 223366 - DNA, 25 bp, E. coli
gtcatcgttaaactatcattcaccg

SEQ ID NO: 223367 - DNA, 25 bp, E. coli
gtcatcgttaaagtatcattcaccg

SEQ ID NO: 223368 - DNA, 25 bp, E. coli
taaactatcattcaccgattttctg

SEQ ID NO: 223369 - DNA, 25 bp, E. coli
gacctgtcatcgttaaactatcatt

SEQ ID NO: 223370 - DNA, 25 bp, E. coli
gacctgtcatcgataaactatcatt

SEQ ID NO: 223371 - DNA, 25 bp, E. coli
caaagcagaatggaaagcgaatccg

SEQ ID NO: 223372 - DNA, 25 bp, E. coli
caaagcagaatgcaaagcgaatccg

SEQ ID NO: 223373 - DNA, 25 bp, E. coli
caaatggctaccagccggatcgtta

SEQ ID NO: 223374 - DNA, 25 bp, E. coli
caaatggctacctgccggatcgtta

SEQ ID NO: 223375 - DNA, 25 bp, E. coli
tgttttcgttcgtcagaccgttttg

SEQ ID NO: 223376 - DNA, 25 bp, E. coli
tgttttcgttcgacagaccgttttg

SEQ ID NO: 223377 - DNA, 25 bp, E. coli
tatggtgtcggcctgaatatcgcat

SEQ ID NO: 223378 - DNA, 25 bp, E. coli
tatggtgtcggcgtgaatatcgcat

SEQ ID NO: 223379 - DNA, 25 bp, E. coli
tatcacaaatgggtaccagccggat

SEQ ID NO: 223380 - DNA, 25 bp, E. coli
tatcacaaatggctaccagccggat

SEQ ID NO: 223381 - DNA, 25 bp, E. coli
tgtcggcgtgaaaatcgcatggcga

SEQ ID NO: 223382 - DNA, 25 bp, E. coli
tgtcggcgtgaatatcgcatggcga

SEQ ID NO: 223383 - DNA, 25 bp, E. coli
tgaagattgttttcgttcgacagac

SEQ ID NO: 223384 - DNA, 25 bp, E. coli
tgaagattgtttacgttcgacagac

SEQ ID NO: 223385 - DNA, 25 bp, E. coli
tgaatatcgcatcgcgatttgagta

SEQ ID NO: 223386 - DNA, 25 bp, E. coli
tgaatatcgcatggcgatttgagta

SEQ ID NO: 223387 - DNA, 25 bp, E. coli
gcagaatggaaagcgaatccgcaac

SEQ ID NO: 223388 - DNA, 25 bp, E. coli
gcagaatggaaaccgaatccgcaac

SEQ ID NO: 223389 - DNA, 25 bp, E. coli
gattgttttcgttcgacagaccgtt

SEQ ID NO: 223390 - DNA, 25 bp, E. coli
gattgttttcgtacgacagaccgtt

SEQ ID NO: 223391 - DNA, 25 bp, E. coli
tggaaagcgaatccgcaacaagcgc

SEQ ID NO: 223392 - DNA, 25 bp, E. coli
tggaaagcgaatgcgcaacaagcgc

SEQ ID NO: 223393 - DNA, 25 bp, E. coli
aagctgtgggagttgataagtcgca

SEQ ID NO: 223394 - DNA, 25 bp, E. coli
aagctgtgggagatgataagtcgca

SEQ ID NO: 223395 - DNA, 25 bp, E. coli
caaaatcgcaatccttggaactgag

SEQ ID NO: 223396 - DNA, 25 bp, E. coli
caaaatcgcaatgcttggaactgag

SEQ ID NO: 223397 - DNA, 25 bp, E. coli
catggctcgattggcgcgacaagtt

SEQ ID NO: 223398 - DNA, 25 bp, E. coli
catggctcgattcgcgcgacaagtt

SEQ ID NO: 223399 - DNA, 25 bp, E. coli
ttcgtgcaaacatacgcaacgaggc

SEQ ID NO: 223400 - DNA, 25 bp, E. coli
ttcgtgcaaacaaacgcaacgaggc

SEQ ID NO: 223401 - DNA, 25 bp, E. coli
tcgttgacgacgtcatggctcgatt

SEQ ID NO: 223402 - DNA, 25 bp, E. coli
tcgttgacgacgacatggctcgatt

SEQ ID NO: 223403 - DNA, 25 bp, E. coli
gcaacgaggctcaacgaatcgagag

SEQ ID NO: 223404 - DNA, 25 bp, E. coli
gcaacgaggctctacgaatcgagag

SEQ ID NO: 223405 - DNA, 25 bp, E. coli
gactggattccatagttctcaatgc

SEQ ID NO: 223406 - DNA, 25 bp, E. coli
gactggattccaaagttctcaatgc

SEQ ID NO: 223407 - DNA, 25 bp, E. coli
cgaatcgagagtccgttgcttaaca

SEQ ID NO: 223408 - DNA, 25 bp, E. coli
cgaatcgagagtgcgttgcttaaca

SEQ ID NO: 223409 - DNA, 25 bp, E. coli
cgacaagttgctccgattctcacca

SEQ ID NO: 223410 - DNA, 25 bp, E. coli
cgacaagttgctgcgattctcacca

SEQ ID NO: 223411 - DNA, 25 bp, E. coli
gataagtcgcagttcagcaggtgga

SEQ ID NO: 223412 - DNA, 25 bp, E. coli
gataagtcgcagatcagcaggtgga

SEQ ID NO: 223413 - DNA, 25 bp, E. coli
tggaactgagaacacagcggaagct

SEQ ID NO: 223414 - DNA, 25 bp, E. coli
tggaactgagaagacagcggaagct

SEQ ID NO: 223415 - DNA, 25 bp, E. coli
caatgctgccgaagtctgtctgtgt

SEQ ID NO: 223416 - DNA, 25 bp, E. coli
caatgctgccgatgtctgtctgtgt

SEQ ID NO: 223417 - DNA, 25 bp, E. coli
caggtgggcatgtttaaccaggcct

SEQ ID NO: 223418 - DNA, 25 bp, E. coli
caggtgggcatgattaaccaggcct

SEQ ID NO: 223419 - DNA, 25 bp, E. coli
tatgctgcctaaagtggaagctgcc

SEQ ID NO: 223420 - DNA, 25 bp, E. coli
tatcgataaagactgggccagcgcc

SEQ ID NO: 223421 - DNA, 25 bp, E. coli
tatgctgcctaatgtggaagctgcc

SEQ ID NO: 223422 - DNA, 25 bp, E. coli
tatcgataaagagtgggccagcgcc

SEQ ID NO: 223423 - DNA, 25 bp, E. coli
tctcgcgcaggtcgtgaagcactga

SEQ ID NO: 223424 - DNA, 25 bp, E. coli
tctgactgcggtagaaaaagtggcc

SEQ ID NO: 223425 - DNA, 25 bp, E. coli
tctcgcgcaggtggtgaagcactga

SEQ ID NO: 223426 - DNA, 25 bp, E. coli
tctgactgcggttgaaaaagtggcc

SEQ ID NO: 223427 - DNA, 25 bp, E. coli
gccagcgcccgtttagcagaaatga

SEQ ID NO: 223428 - DNA, 25 bp, E. coli
gccagcgcccgtatagcagaaatga

SEQ ID NO: 223429 - DNA, 25 bp, E. coli
gaagcactgattaccgtattgagca

SEQ ID NO: 223430 - DNA, 25 bp, E. coli
gaaggtaaccatctgcgtggtgcca

SEQ ID NO: 223431 - DNA, 25 bp, E. coli
gaagcactgatttccgtattgagca

SEQ ID NO: 223432 - DNA, 25 bp, E. coli
gaaggtaaccatgtgcgtggtgcca

SEQ ID NO: 223433 - DNA, 25 bp, E. coli
gagaatgaacagaggctcgatcgcc

SEQ ID NO: 223434 - DNA, 25 bp, E. coli
gagaatgaacagtggctcgatcgcc

SEQ ID NO: 223435 - DNA, 25 bp, E. coli
gatgctgaacgcattatcgaagaag

SEQ ID NO: 223436 - DNA, 25 bp, E. coli
gatgctgaacgctttatcgaagaag

SEQ ID NO: 223437 - DNA, 25 bp, E. coli
acgtgctgatcacaccgctggtcgc

SEQ ID NO: 223438 - DNA, 25 bp, E. coli
atgagtacggtcagcgcctgggaat

SEQ ID NO: 223439 - DNA, 25 bp, E. coli
atgagtacggtctgcgcctgggaat

SEQ ID NO: 223440 - DNA, 25 bp, E. coli
acgtgctgatcagaccgctggtcgc

SEQ ID NO: 223441 - DNA, 25 bp, E. coli
tatgcgcatgattgtcagttggtgg

SEQ ID NO: 223442 - DNA, 25 bp, E. coli
tatccctcttcctgcggtggttaca

SEQ ID NO: 223443 - DNA, 25 bp, E. coli
tatgcgcatgatagtcagttggtgg

SEQ ID NO: 223444 - DNA, 25 bp, E. coli
tatccctcttccagcggtggttaca

SEQ ID NO: 223445 - DNA, 25 bp, E. coli
cctttgatgagtacggtcagcgcct

SEQ ID NO: 223446 - DNA, 25 bp, E. coli
cctttgatgagttcggtcagcgcct

SEQ ID NO: 223447 - DNA, 25 bp, E. coli
gaagagtgggatttccctcttcctg

SEQ ID NO: 223448 - DNA, 25 bp, E. coli
gaagagtgggatatccctcttcctg

SEQ ID NO: 223449 - DNA, 25 bp, E. coli
cccctttcccgaatagacgtgctga

SEQ ID NO: 223450 - DNA, 25 bp, E. coli
ccgctggtcgcctttgatgagtacg

SEQ ID NO: 223451 - DNA, 25 bp, E. coli
ccccgttgaagagtgggatatccct

SEQ ID NO: 223452 - DNA, 25 bp, E. coli
cccctttcccgattagacgtgctga

SEQ ID NO: 223453 - DNA, 25 bp, E. coli
ccgctggtcgccattgatgagtacg

SEQ ID NO: 223454 - DNA, 25 bp, E. coli
ccccgttgaagactgggatatccct

SEQ ID NO: 223455 - DNA, 25 bp, E. coli
gattagacgtgctgatcacaccgct

SEQ ID NO: 223456 - DNA, 25 bp, E. coli
gattgtcagttgctggaaaaactcc

SEQ ID NO: 223457 - DNA, 25 bp, E. coli
gattgtcagttggtggaaaaactcc

SEQ ID NO: 223458 - DNA, 25 bp, E. coli
gattagacgtgcagatcacaccgct

SEQ ID NO: 223459 - DNA, 25 bp, E. coli
caaatgggttatgacgactatccgt

SEQ ID NO: 223460 - DNA, 25 bp, E. coli
caaatgggttatcacgactatccgt

SEQ ID NO: 223461 - DNA, 25 bp, E. coli
catgtattcacggattgggcgtcgt

SEQ ID NO: 223462 - DNA, 25 bp, E. coli
catgtattcacgcattgggcgtcgt

SEQ ID NO: 223463 - DNA, 25 bp, E. coli
tacagcaccgcgattggtaaggtac

SEQ ID NO: 223464 - DNA, 25 bp, E. coli
taacgcagatctcgataaacagcct

SEQ ID NO: 223465 - DNA, 25 bp, E. coli
tacagcaccgcgtttggtaaggtac

SEQ ID NO: 223466 - DNA, 25 bp, E. coli
tgtcgcagcgcgtcatgatgtcaaa

SEQ ID NO: 223467 - DNA, 25 bp, E. coli
tgtcgcagcgcgacatgatgtcaaa

SEQ ID NO: 223468 - DNA, 25 bp, E. coli
tgaccaaagaaactatccacctcgg

SEQ ID NO: 223469 - DNA, 25 bp, E. coli
tgaagagcgcgaaatagggataacc

SEQ ID NO: 223470 - DNA, 25 bp, E. coli
tgaccaaagaaagtatccacctcgg

SEQ ID NO: 223471 - DNA, 25 bp, E. coli
tgaagagcgcgatatagggataacc

SEQ ID NO: 223472 - DNA, 25 bp, E. coli
ccgacgttgcgtatctctgaagagc

SEQ ID NO: 223473 - DNA, 25 bp, E. coli
ccgacgttgcgtttctctgaagagc

SEQ ID NO: 223474 - DNA, 25 bp, E. coli
ggaccatcaccagtacagaagcgtt

SEQ ID NO: 223475 - DNA, 25 bp, E. coli
ggaccatcaccactacagaagcgtt

SEQ ID NO: 223476 - DNA, 25 bp, E. coli
taattcgtagcggagatatccagat

SEQ ID NO: 223477 - DNA, 25 bp, E. coli
taacgcagatctggataaacagcct

SEQ ID NO: 223478 - DNA, 25 bp, E. coli
taattcgtagcgcagatatccagat

SEQ ID NO: 223479 - DNA, 25 bp, E. coli
gagtataaacgcagtaccgagcgga

SEQ ID NO: 223480 - DNA, 25 bp, E. coli
gagtataaacgctgtaccgagcgga

SEQ ID NO: 223481 - DNA, 25 bp, E. coli
aaagatgctgcgcaaaaatacccgc

SEQ ID NO: 223482 - DNA, 25 bp, E. coli
aaagatgctgcggaaaaatacccgc

SEQ ID NO: 223483 - DNA, 25 bp, E. coli
tgagtcattaaatgcagtattccca

SEQ ID NO: 223484 - DNA, 25 bp, E. coli
tgagtcattaaaagcagtattccca

SEQ ID NO: 223485 - DNA, 25 bp, E. coli
gcaatggtctttattgaatcgcaaa

SEQ ID NO: 223486 - DNA, 25 bp, E. coli
gcacctgataactcaaaaagcattg

SEQ ID NO: 223487 - DNA, 25 bp, E. coli
gaattacgtgttctagcaatggtct

SEQ ID NO: 223488 - DNA, 25 bp, E. coli
gcagtattcccatctctggataact

SEQ ID NO: 223489 - DNA, 25 bp, E. coli
gcaatggtcttttttgaatcgcaaa

SEQ ID NO: 223490 - DNA, 25 bp, E. coli
gaatcgcaaaagtgctacatacgtg

SEQ ID NO: 223491 - DNA, 25 bp, E. coli
gaattacgtgttgtagcaatggtct

SEQ ID NO: 223492 - DNA, 25 bp, E. coli
gcacctgataacacaaaaagcattg

SEQ ID NO: 223493 - DNA, 25 bp, E. coli
gaatcgcaaaagagctacatacgtg

SEQ ID NO: 223494 - DNA, 25 bp, E. coli
gcagtattcccaactctggataact

SEQ ID NO: 223495 - DNA, 25 bp, E. coli
gataacttcaaatatctggataagc

SEQ ID NO: 223496 - DNA, 25 bp, E. coli
gataacttcaaaaatctggataagc

SEQ ID NO: 223497 - DNA, 25 bp, E. coli
gggatatttcaaaaaacctgagtca

SEQ ID NO: 223498 - DNA, 25 bp, E. coli
gggaacacgattgctaagggatatt

SEQ ID NO: 223499 - DNA, 25 bp, E. coli
gggatatttcaataaacctgagtca

SEQ ID NO: 223500 - DNA, 25 bp, E. coli
gggaacacgattcctaagggatatt

SEQ ID NO: 223501 - DNA, 25 bp, E. coli
tacccgcaacataaaacggagttgg

SEQ ID NO: 223502 - DNA, 25 bp, E. coli
tacccgcaacattaaacggagttgg

SEQ ID NO: 223503 - DNA, 25 bp, E. coli
ttagcgttttgttattcgacgaaag

SEQ ID NO: 223504 - DNA, 25 bp, E. coli
ttagcgttttgtaattcgacgaaag

SEQ ID NO: 223505 - DNA, 25 bp, E. coli
tttattggatttaattaggtctggc

SEQ ID NO: 223506 - DNA, 25 bp, E. coli
tttattggattttattaggtctggc

SEQ ID NO: 223507 - DNA, 25 bp, E. coli
ttttaatgctggtgatgatttctct

SEQ ID NO: 223508 - DNA, 25 bp, E. coli
ttttaatgctggagatgatttctct

SEQ ID NO: 223509 - DNA, 25 bp, E. coli
tgctacagaaataaccggtacgctg

SEQ ID NO: 223510 - DNA, 25 bp, E. coli
tgctacagaaattaccggtacgctg

SEQ ID NO: 223511 - DNA, 25 bp, E. coli
tgaactggaggtgaaccatggcgca

SEQ ID NO: 223512 - DNA, 25 bp, E. coli
tgaactggaggtcaaccatggcgca

SEQ ID NO: 223513 - DNA, 25 bp, E. coli
tcagtgagggaattggcggctttat

SEQ ID NO: 223514 - DNA, 25 bp, E. coli
tcagtgagggaaatggcggctttat

SEQ ID NO: 223515 - DNA, 25 bp, E. coli
gctgatgaaaatagccgggttaacc

SEQ ID NO: 223516 - DNA, 25 bp, E. coli
gctgatgaaaattgccgggttaacc

SEQ ID NO: 223517 - DNA, 25 bp, E. coli
cgctgtgggaagctatcggtatttt

SEQ ID NO: 223518 - DNA, 25 bp, E. coli
cgctgtgggaaggtatcggtatttt

SEQ ID NO: 223519 - DNA, 25 bp, E. coli
gatttctctgtcgtatatatttctc

SEQ ID NO: 223520 - DNA, 25 bp, E. coli
gatttctctgtcctatatatttctc

SEQ ID NO: 223521 - DNA, 25 bp, E. coli
ggcggctttattttaatgctggtga

SEQ ID NO: 223522 - DNA, 25 bp, E. coli
ggcggctttattataatgctggtga

SEQ ID NO: 223523 - DNA, 25 bp, E. coli
taaacctgaactggaggtgaaccat

SEQ ID NO: 223524 - DNA, 25 bp, E. coli
taaacctgaactcgaggtgaaccat

SEQ ID NO: 223525 - DNA, 25 bp, E. coli
caatatgcccatctttattctgtcg

SEQ ID NO: 223526 - DNA, 25 bp, E. coli
caatatgcccatgtttattctgtcg

SEQ ID NO: 223527 - DNA, 25 bp, E. coli
cagcggatgagtcattttttgccca

SEQ ID NO: 223528 - DNA, 25 bp, E. coli
cagcggatgagtgattttttgccca

SEQ ID NO: 223529 - DNA, 25 bp, E. coli
accgttgccacgcatatgacgctga

SEQ ID NO: 223530 - DNA, 25 bp, E. coli
agttgaaggtcattatgcccatgtt

SEQ ID NO: 223531 - DNA, 25 bp, E. coli
accgttgccacggatatgacgctga

SEQ ID NO: 223532 - DNA, 25 bp, E. coli
agttgaaggtcaatatgcccatgtt

SEQ ID NO: 223533 - DNA, 25 bp, E. coli
tatgcccatgttaattctgtcgata

SEQ ID NO: 223534 - DNA, 25 bp, E. coli
tatgcccatgtttattctgtcgata

SEQ ID NO: 223535 - DNA, 25 bp, E. coli
tgccacgcatatgacgctgaaataa

SEQ ID NO: 223536 - DNA, 25 bp, E. coli
tgccacgcatatcacgctgaaataa

SEQ ID NO: 223537 - DNA, 25 bp, E. coli
tcgccagcggatcagtcattttttg

SEQ ID NO: 223538 - DNA, 25 bp, E. coli
tcgccagcggatgagtcattttttg

SEQ ID NO: 223539 - DNA, 25 bp, E. coli
gcaatgaaacgctgtcatttatttt

SEQ ID NO: 223540 - DNA, 25 bp, E. coli
gcaatgaaacgcagtcatttatttt

SEQ ID NO: 223541 - DNA, 25 bp, E. coli
cgttgccacgcatatgacgctgaaa

SEQ ID NO: 223542 - DNA, 25 bp, E. coli
cgttgccacgcaaatgacgctgaaa

SEQ ID NO: 223543 - DNA, 25 bp, E. coli
catttattttaaggcctgcaccggg

SEQ ID NO: 223544 - DNA, 25 bp, E. coli
cggatgagtcatattttgcccaact

SEQ ID NO: 223545 - DNA, 25 bp, E. coli
cggatgagtcattttttgcccaact

SEQ ID NO: 223546 - DNA, 25 bp, E. coli
catttattttaacgcctgcaccggg

SEQ ID NO: 223547 - DNA, 25 bp, E. coli
attcgttggcctgggttgatagaaa

SEQ ID NO: 223548 - DNA, 25 bp, E. coli
aggttcattcgttggcctcggttga

SEQ ID NO: 223549 - DNA, 25 bp, E. coli
aggttcattcgtaggcctcggttga

SEQ ID NO: 223550 - DNA, 25 bp, E. coli
attcgttggcctcggttgatagaaa

SEQ ID NO: 223551 - DNA, 25 bp, E. coli
taggttcattcgatggcctcggttg

SEQ ID NO: 223552 - DNA, 25 bp, E. coli
taggttcattcgttggcctcggttg

SEQ ID NO: 223553 - DNA, 25 bp, E. coli
tgatagaaatatcggtcggggcctt

SEQ ID NO: 223554 - DNA, 25 bp, E. coli
tgatagaaatatgggtcggggcctt

SEQ ID NO: 223555 - DNA, 25 bp, E. coli
tcgttggcctcgcttgatagaaata

SEQ ID NO: 223556 - DNA, 25 bp, E. coli
tcgttggcctcggttgatagaaata

SEQ ID NO: 223557 - DNA, 25 bp, E. coli
tcattcgttggcgtcggttgataga

SEQ ID NO: 223558 - DNA, 25 bp, E. coli
tcattcgttggcctcggttgataga

SEQ ID NO: 223559 - DNA, 25 bp, E. coli
gctaggttcattcgttggcctcggt

SEQ ID NO: 223560 - DNA, 25 bp, E. coli
gctaggttcattggttggcctcggt

SEQ ID NO: 223561 - DNA, 25 bp, E. coli
cgttggcctcggatgatagaaatat

SEQ ID NO: 223562 - DNA, 25 bp, E. coli
cgttggcctcggttgatagaaatat

SEQ ID NO: 223563 - DNA, 25 bp, E. coli
cattcgttggccacggttgatagaa

SEQ ID NO: 223564 - DNA, 25 bp, E. coli
cattcgttggcctcggttgatagaa

SEQ ID NO: 223565 - DNA, 25 bp, E. coli
ggttcattcgttcgcctcggttgat

SEQ ID NO: 223566 - DNA, 25 bp, E. coli
ggttcattcgttggcctcggttgat

SEQ ID NO: 223567 - DNA, 25 bp, E. coli
tagaaatatcggacggggccttcgt

SEQ ID NO: 223568 - DNA, 25 bp, E. coli
tagaaatatcggtcggggccttcgt

SEQ ID NO: 223569 - DNA, 25 bp, E. coli
caatgcctctctactgtagcgttct

SEQ ID NO: 223570 - DNA, 25 bp, E. coli
caatgcctctcttctgtagcgttct

SEQ ID NO: 223571 - DNA, 25 bp, E. coli
taaaaatggcgctgtatttgcgcca

SEQ ID NO: 223572 - DNA, 25 bp, E. coli
taaaaatggcgcagtatttgcgcca

SEQ ID NO: 223573 - DNA, 25 bp, E. coli
tagcgttcttcggatctacatcatc

SEQ ID NO: 223574 - DNA, 25 bp, E. coli
tacatcatcctgaagtagcgcgata

SEQ ID NO: 223575 - DNA, 25 bp, E. coli
tacatcatcctgtagtagcgcgata

SEQ ID NO: 223576 - DNA, 25 bp, E. coli
ataattaattgcactgccccgccag

SEQ ID NO: 223577 - DNA, 25 bp, E. coli
ataattaattgctctgccccgccag

SEQ ID NO: 223578 - DNA, 25 bp, E. coli
tagcgttcttcgcatctacatcatc

SEQ ID NO: 223579 - DNA, 25 bp, E. coli
tatttgccagcaacaatgcctctct

SEQ ID NO: 223580 - DNA, 25 bp, E. coli
tatctgcatcagtatataaaaagca

SEQ ID NO: 223581 - DNA, 25 bp, E. coli
tttaacctataataatggcgctgta

SEQ ID NO: 223582 - DNA, 25 bp, E. coli
tatttgccagcatcaatgcctctct

SEQ ID NO: 223583 - DNA, 25 bp, E. coli
tatactcactgagtatctgcatcag

SEQ ID NO: 223584 - DNA, 25 bp, E. coli
tatctgcatcagaatataaaaagca

SEQ ID NO: 223585 - DNA, 25 bp, E. coli
tatactcactgactatctgcatcag

SEQ ID NO: 223586 - DNA, 25 bp, E. coli
tttaacctataaaaatggcgctgta

SEQ ID NO: 223587 - DNA, 25 bp, E. coli
gaagtagcgcgatatactcactgac

SEQ ID NO: 223588 - DNA, 25 bp, E. coli
gaagtagcgcgaaatactcactgac

SEQ ID NO: 223589 - DNA, 25 bp, E. coli
ccgatacttcttgtatttgccagca

SEQ ID NO: 223590 - DNA, 25 bp, E. coli
ccgatacttcttctatttgccagca

SEQ ID NO: 223591 - DNA, 25 bp, E. coli
cagcttcaataaaggtaataatctt

SEQ ID NO: 223592 - DNA, 25 bp, E. coli
cagcttcaataatggtaataatctt

SEQ ID NO: 223593 - DNA, 25 bp, E. coli
agttctttcccgtccagagcccgtg

SEQ ID NO: 223594 - DNA, 25 bp, E. coli
agttctttcccgaccagagcccgtg

SEQ ID NO: 223595 - DNA, 25 bp, E. coli
agtgcaagcaaacttgctactttgg

SEQ ID NO: 223596 - DNA, 25 bp, E. coli
agtgcaagcaaagttgctactttgg

SEQ ID NO: 223597 - DNA, 25 bp, E. coli
ttagagttctttgccgtccagagcc

SEQ ID NO: 223598 - DNA, 25 bp, E. coli
ttagagttctttcccgtccagagcc

SEQ ID NO: 223599 - DNA, 25 bp, E. coli
ttcatgcgttggagtgtagtagacc

SEQ ID NO: 223600 - DNA, 25 bp, E. coli
ttcatgcgttggtgtgtagtagacc

SEQ ID NO: 223601 - DNA, 25 bp, E. coli
ttggagtgtagtagaccagtcggtc

SEQ ID NO: 223602 - DNA, 25 bp, E. coli
ttggagtgtagttgaccagtcggtc

SEQ ID NO: 223603 - DNA, 25 bp, E. coli
tgtgtttgttcaagcgttggagtgt

SEQ ID NO: 223604 - DNA, 25 bp, E. coli
tgtgtttgttcatgcgttggagtgt

SEQ ID NO: 223605 - DNA, 25 bp, E. coli
tcggtctagtgctagcaaagttgct

SEQ ID NO: 223606 - DNA, 25 bp, E. coli
tgccggggaatttgccagtctgacg

SEQ ID NO: 223607 - DNA, 25 bp, E. coli
tgccggggaattagccagtctgacg

SEQ ID NO: 223608 - DNA, 25 bp, E. coli
tcggtctagtgcaagcaaagttgct

SEQ ID NO: 223609 - DNA, 25 bp, E. coli
gaccagtcggtctagtgcaagcaaa

SEQ ID NO: 223610 - DNA, 25 bp, E. coli
ggagcaattagagttctttcccgtc

SEQ ID NO: 223611 - DNA, 25 bp, E. coli
ggagcaattagacttctttcccgtc

SEQ ID NO: 223612 - DNA, 25 bp, E. coli
gaccagtcggtcaagtgcaagcaaa

SEQ ID NO: 223613 - DNA, 25 bp, E. coli
aagatagccgcatagccctggtcgg

SEQ ID NO: 223614 - DNA, 25 bp, E. coli
aagatagccgcaaagccctggtcgg

SEQ ID NO: 223615 - DNA, 25 bp, E. coli
caaaccgtgcaggtgaagggcgaaa

SEQ ID NO: 223616 - DNA, 25 bp, E. coli
caaaccgtgcagctgaagggcgaaa

SEQ ID NO: 223617 - DNA, 25 bp, E. coli
taaaattatcgttcaggagatgggc

SEQ ID NO: 223618 - DNA, 25 bp, E. coli
taaaattatcgtacaggagatgggc

SEQ ID NO: 223619 - DNA, 25 bp, E. coli
tagccgcgttgtcactctggaagat

SEQ ID NO: 223620 - DNA, 25 bp, E. coli
tagccgcgttgtgactctggaagat

SEQ ID NO: 223621 - DNA, 25 bp, E. coli
tgaccaaacttgttgcgcagctgaa

SEQ ID NO: 223622 - DNA, 25 bp, E. coli
tgatgaaggcgccaaaagccgcgtc

SEQ ID NO: 223623 - DNA, 25 bp, E. coli
tgatgaaggcgcgaaaagccgcgtc

SEQ ID NO: 223624 - DNA, 25 bp, E. coli
tgaccaaacttgatgcgcagctgaa

SEQ ID NO: 223625 - DNA, 25 bp, E. coli
gcactttcagtgacggcaatgaccg

SEQ ID NO: 223626 - DNA, 25 bp, E. coli
gcaatcctcaatccaaaccgagtgg

SEQ ID NO: 223627 - DNA, 25 bp, E. coli
gcactttcagtgtcggcaatgaccg

SEQ ID NO: 223628 - DNA, 25 bp, E. coli
gcaatcctcaatgcaaaccgagtgg

SEQ ID NO: 223629 - DNA, 25 bp, E. coli
gaaaacggcaatctggtgatcacgc

SEQ ID NO: 223630 - DNA, 25 bp, E. coli
gaaaacggcaatgtggtgatcacgc

SEQ ID NO: 223631 - DNA, 25 bp, E. coli
cgccagacggcatcgtgatgtataa

SEQ ID NO: 223632 - DNA, 25 bp, E. coli
cgccagacggcaacgtgatgtataa

SEQ ID NO: 223633 - DNA, 25 bp, E. coli
gacgatgtgattgtcagcccgcaaa

SEQ ID NO: 223634 - DNA, 25 bp, E. coli
gacgatgtgattctcagcccgcaaa

SEQ ID NO: 223635 - DNA, 25 bp, E. coli
taacaccagaaacgctggtcacacg

SEQ ID NO: 223636 - DNA, 25 bp, E. coli
taacaccagaaaggctggtcacacg

SEQ ID NO: 223637 - DNA, 25 bp, E. coli
aaatggtacgagatcacgggtgagc

SEQ ID NO: 223638 - DNA, 25 bp, E. coli
aaatggtacgagttcacgggtgagc

SEQ ID NO: 223639 - DNA, 25 bp, E. coli
tacccgtactttcagcgtcgaacag

SEQ ID NO: 223640 - DNA, 25 bp, E. coli
tacccgtactttgagcgtcgaacag

SEQ ID NO: 223641 - DNA, 25 bp, E. coli
tatttgatcaatcgtgaggctcgcg

SEQ ID NO: 223642 - DNA, 25 bp, E. coli
tatttgatcaatggtgaggctcgcg

SEQ ID NO: 223643 - DNA, 25 bp, E. coli
tgatcaatggtgaggctcgcgctcg

SEQ ID NO: 223644 - DNA, 25 bp, E. coli
tgatcaatggtgtggctcgcgctcg

SEQ ID NO: 223645 - DNA, 25 bp, E. coli
gcgcgattgtaaggaaaaactgttc

SEQ ID NO: 223646 - DNA, 25 bp, E. coli
gcgcgattgtaacgaaaaactgttc

SEQ ID NO: 223647 - DNA, 25 bp, E. coli
gaacagaactaccataaatggtacg

SEQ ID NO: 223648 - DNA, 25 bp, E. coli
gaacagaactacgataaatggtacg

SEQ ID NO: 223649 - DNA, 25 bp, E. coli
ctttgagcgtcgaacagaactacga

SEQ ID NO: 223650 - DNA, 25 bp, E. coli
ctttgagcgtcgtacagaactacga

SEQ ID NO: 223651 - DNA, 25 bp, E. coli
ggctcgcgctcgtacccgtactttg

SEQ ID NO: 223652 - DNA, 25 bp, E. coli
ggctcgcgctcgaacccgtactttg

SEQ ID NO: 223653 - DNA, 25 bp, E. coli
tcacgggtgagcaggatctgccgct

SEQ ID NO: 223654 - DNA, 25 bp, E. coli
tcacgggtgagctggatctgccgct

SEQ ID NO: 223655 - DNA, 25 bp, E. coli
gagatggccgatgtctatttgatca

SEQ ID NO: 223656 - DNA, 25 bp, E. coli
gagatggccgatctctatttgatca

SEQ ID NO: 223657 - DNA, 25 bp, E. coli
caagtcaggagtcgagctacgtcac

SEQ ID NO: 223658 - DNA, 25 bp, E. coli
caagtcaggagtggagctacgtcac

SEQ ID NO: 223659 - DNA, 25 bp, E. coli
tagcggtcgcctgaaagatcgtaaa

SEQ ID NO: 223660 - DNA, 25 bp, E. coli
aacaggtcgcggtgaaaggtattcg

SEQ ID NO: 223661 - DNA, 25 bp, E. coli
acaccggtaccgcattgcggcgaga

SEQ ID NO: 223662 - DNA, 25 bp, E. coli
acaccggtaccggattgcggcgaga

SEQ ID NO: 223663 - DNA, 25 bp, E. coli
aacaggtcgcggagaaaggtattcg

SEQ ID NO: 223664 - DNA, 25 bp, E. coli
tagcggtcgcctcaaagatcgtaaa

SEQ ID NO: 223665 - DNA, 25 bp, E. coli
tatcccaaacagaaacaaccgacgc

SEQ ID NO: 223666 - DNA, 25 bp, E. coli
tatcccaaacagtaacaaccgacgc

SEQ ID NO: 223667 - DNA, 25 bp, E. coli
tttaaaagacccgaccacgcagtat

SEQ ID NO: 223668 - DNA, 25 bp, E. coli
tttaaaagaccccaccacgcagtat

SEQ ID NO: 223669 - DNA, 25 bp, E. coli
gcgatcagttatcttcccgtggaag

SEQ ID NO: 223670 - DNA, 25 bp, E. coli
gcgatcagttatgttcccgtggaag

SEQ ID NO: 223671 - DNA, 25 bp, E. coli
gctacgtcaccggagaagtgcacgg

SEQ ID NO: 223672 - DNA, 25 bp, E. coli
gctacgtcaccgcagaagtgcacgg

SEQ ID NO: 223673 - DNA, 25 bp, E. coli
gaatgcggacgctaagccgttctgc

SEQ ID NO: 223674 - DNA, 25 bp, E. coli
gaatgcggacgcaaagccgttctgc

SEQ ID NO: 223675 - DNA, 25 bp, E. coli
gaaaacctatgtaggtagcggtcgc

SEQ ID NO: 223676 - DNA, 25 bp, E. coli
gaaaacctatgttggtagcggtcgc

SEQ ID NO: 223677 - DNA, 25 bp, E. coli
gatattgcagacctcaccagcgaac

SEQ ID NO: 223678 - DNA, 25 bp, E. coli
gatattgcagacgtcaccagcgaac

SEQ ID NO: 223679 - DNA, 25 bp, E. coli
cagtacgccgggagattatgacgct

SEQ ID NO: 223680 - DNA, 25 bp, E. coli
caaaaccctgcatacagaagtgcgg

SEQ ID NO: 223681 - DNA, 25 bp, E. coli
caaaaccctgcaaacagaagtgcgg

SEQ ID NO: 223682 - DNA, 25 bp, E. coli
cagtacgccgggtgattatgacgct

SEQ ID NO: 223683 - DNA, 25 bp, E. coli
agcattacgcttgatggctgcagga

SEQ ID NO: 223684 - DNA, 25 bp, E. coli
agcattacgcttcatggctgcagga

SEQ ID NO: 223685 - DNA, 25 bp, E. coli
actttgacgcagtacgccgggagat

SEQ ID NO: 223686 - DNA, 25 bp, E. coli
actttgacgcagaacgccgggagat

SEQ ID NO: 223687 - DNA, 25 bp, E. coli
ttcatggctgcaggaggcgctcagt

SEQ ID NO: 223688 - DNA, 25 bp, E. coli
ttcatggctgcacgaggcgctcagt

SEQ ID NO: 223689 - DNA, 25 bp, E. coli
tagtgaattcccagcggcgcttaag

SEQ ID NO: 223690 - DNA, 25 bp, E. coli
tcttgagctgctaagtgaattccct

SEQ ID NO: 223691 - DNA, 25 bp, E. coli
tcttgagctgcttagtgaattccct

SEQ ID NO: 223692 - DNA, 25 bp, E. coli
tagtgaattccctgcggcgcttaag

SEQ ID NO: 223693 - DNA, 25 bp, E. coli
gcggaaaacgtttatcaggcaagga

SEQ ID NO: 223694 - DNA, 25 bp, E. coli
gcggaaaacgttaatcaggcaagga

SEQ ID NO: 223695 - DNA, 25 bp, E. coli
gggattgttactggcaccacttatc

SEQ ID NO: 223696 - DNA, 25 bp, E. coli
gggattgttactcgcaccacttatc

SEQ ID NO: 223697 - DNA, 25 bp, E. coli
ggataaaatcgcatatgaagccgct

SEQ ID NO: 223698 - DNA, 25 bp, E. coli
ggataaaatcgcttatgaagccgct

SEQ ID NO: 223699 - DNA, 25 bp, E. coli
gatgcctaccgtgatgaactgcgcc

SEQ ID NO: 223700 - DNA, 25 bp, E. coli
gatgcctaccgtcatgaactgcgcc

SEQ ID NO: 223701 - DNA, 25 bp, E. coli
aaaatggcgttttgtctcacgagga

SEQ ID NO: 223702 - DNA, 25 bp, E. coli
aaaatggcgtttagtctcacgagga

SEQ ID NO: 223703 - DNA, 25 bp, E. coli
tatatgtcacctggtcagataaggg

SEQ ID NO: 223704 - DNA, 25 bp, E. coli
tatatgtcacctcgtcagataaggg

SEQ ID NO: 223705 - DNA, 25 bp, E. coli
tgatggtcaacataggctgacgacc

SEQ ID NO: 223706 - DNA, 25 bp, E. coli
tgatggtcaacaaaggctgacgacc

SEQ ID NO: 223707 - DNA, 25 bp, E. coli
tctggccgatctcgcggttcaggtc

SEQ ID NO: 223708 - DNA, 25 bp, E. coli
tctggccgatctggcggttcaggtc

SEQ ID NO: 223709 - DNA, 25 bp, E. coli
gaagatattcacttctacgcggagt

SEQ ID NO: 223710 - DNA, 25 bp, E. coli
gaagatattcacatctacgcggagt

SEQ ID NO: 223711 - DNA, 25 bp, E. coli
gaaacgatgggatttatatgtcacc

SEQ ID NO: 223712 - DNA, 25 bp, E. coli
gaaatcatcgcttcacggaaagacg

SEQ ID NO: 223713 - DNA, 25 bp, E. coli
gaaacgatgggaattatatgtcacc

SEQ ID NO: 223714 - DNA, 25 bp, E. coli
gaaatcatcgctacacggaaagacg

SEQ ID NO: 223715 - DNA, 25 bp, E. coli
cgcggagtattactgtgcaatggca

SEQ ID NO: 223716 - DNA, 25 bp, E. coli
cgcggagtattagtgtgcaatggca

SEQ ID NO: 223717 - DNA, 25 bp, E. coli
cggaaagacgtcagaatgaaagcta

SEQ ID NO: 223718 - DNA, 25 bp, E. coli
ctgaaaaaggcgaagatcggctggt

SEQ ID NO: 223719 - DNA, 25 bp, E. coli
ctgaaaaaggcgtagatcggctggt

SEQ ID NO: 223720 - DNA, 25 bp, E. coli
cggaaagacgtctgaatgaaagcta

SEQ ID NO: 223721 - DNA, 25 bp, E. coli
gagagagtccttcacgaaacgatgg

SEQ ID NO: 223722 - DNA, 25 bp, E. coli
gagagagtccttgacgaaacgatgg

SEQ ID NO: 223723 - DNA, 25 bp, E. coli
caattgctggctggcagcgtagccc

SEQ ID NO: 223724 - DNA, 25 bp, E. coli
caattgctggctcgcagcgtagccc

SEQ ID NO: 223725 - DNA, 25 bp, E. coli
caaattgagcgcgatgccttgcgtg

SEQ ID NO: 223726 - DNA, 25 bp, E. coli
caaattgagcgccatgccttgcgtg

SEQ ID NO: 223727 - DNA, 25 bp, E. coli
tatggagcggcaaaaaatgtcggca

SEQ ID NO: 223728 - DNA, 25 bp, E. coli
tatggagcggcataaaatgtcggca

SEQ ID NO: 223729 - DNA, 25 bp, E. coli
tattaatgccaggaaaacccggcag

SEQ ID NO: 223730 - DNA, 25 bp, E. coli
tattaatgccagcaaaacccggcag

SEQ ID NO: 223731 - DNA, 25 bp, E. coli
tcaggttcagacactggcggagaaa

SEQ ID NO: 223732 - DNA, 25 bp, E. coli
tcattccgcgcagcaaatgggcgtt

SEQ ID NO: 223733 - DNA, 25 bp, E. coli
tcaggttcagactctggcggagaaa

SEQ ID NO: 223734 - DNA, 25 bp, E. coli
tcattccgcgcaccaaatgggcgtt

SEQ ID NO: 223735 - DNA, 25 bp, E. coli
gcctgtactgggtgtggcaaaccca

SEQ ID NO: 223736 - DNA, 25 bp, E. coli
gcctgtactgggagtggcaaaccca

SEQ ID NO: 223737 - DNA, 25 bp, E. coli
gcagaacaccattatcgcgaccgat

SEQ ID NO: 223738 - DNA, 25 bp, E. coli
gcagaacaccataatcgcgaccgat

SEQ ID NO: 223739 - DNA, 25 bp, E. coli
gaaagcaacttgtctatcgccagct

SEQ ID NO: 223740 - DNA, 25 bp, E. coli
gaaagcaacttgactatcgccagct

SEQ ID NO: 223741 - DNA, 25 bp, E. coli
cgttaaacacggtcttgcagcaaat

SEQ ID NO: 223742 - DNA, 25 bp, E. coli
cgttaaacacggacttgcagcaaat

SEQ ID NO: 223743 - DNA, 25 bp, E. coli
cgatcgccagctttatcagaacggg

SEQ ID NO: 223744 - DNA, 25 bp, E. coli
cgatcgccagctatatcagaacggg

SEQ ID NO: 223745 - DNA, 25 bp, E. coli
cagccatctgcgttatgccgttata

SEQ ID NO: 223746 - DNA, 25 bp, E. coli
cagccatctgcgatatgccgttata

SEQ ID NO: 223747 - DNA, 25 bp, E. coli
catccggcaggatacaataagcaca

SEQ ID NO: 223748 - DNA, 25 bp, E. coli
catccggcaggaaacaataagcaca

SEQ ID NO: 223749 - DNA, 25 bp, E. coli
attgtcagccatctgcgttatgccg

SEQ ID NO: 223750 - DNA, 25 bp, E. coli
attgtcagccatgtgcgttatgccg

SEQ ID NO: 223751 - DNA, 25 bp, E. coli
tgggcgtggcgaggtaccagagtgt

SEQ ID NO: 223752 - DNA, 25 bp, E. coli
tgggcgtggcgacgtaccagagtgt

SEQ ID NO: 223753 - DNA, 25 bp, E. coli
tgccgttatacctgaaacgaatatc

SEQ ID NO: 223754 - DNA, 25 bp, E. coli
tgcgttatgccgttataccagaaac

SEQ ID NO: 223755 - DNA, 25 bp, E. coli
tgccgttataccagaaacgaatatc

SEQ ID NO: 223756 - DNA, 25 bp, E. coli
tgcgttatgccgatataccagaaac

SEQ ID NO: 223757 - DNA, 25 bp, E. coli
gaaacaataagctcattgtcagcca

SEQ ID NO: 223758 - DNA, 25 bp, E. coli
gaaacgaatatcacaacgcctgggc

SEQ ID NO: 223759 - DNA, 25 bp, E. coli
gaaacaataagcacattgtcagcca

SEQ ID NO: 223760 - DNA, 25 bp, E. coli
gaaacgaatatctcaacgcctgggc

SEQ ID NO: 223761 - DNA, 25 bp, E. coli
ccggcaggaaacaataagcacattg

SEQ ID NO: 223762 - DNA, 25 bp, E. coli
cgaatatctcaaggcctgggcgtgg

SEQ ID NO: 223763 - DNA, 25 bp, E. coli
ccggcaggaaactataagcacattg

SEQ ID NO: 223764 - DNA, 25 bp, E. coli
cgaatatctcaacgcctgggcgtgg

SEQ ID NO: 223765 - DNA, 25 bp, E. coli
taagcacattgtgagccatctgcgt

SEQ ID NO: 223766 - DNA, 25 bp, E. coli
taagcacattgtcagccatctgcgt

SEQ ID NO: 223767 - DNA, 25 bp, E. coli
aataacgatgatgcgaccactggcg

SEQ ID NO: 223768 - DNA, 25 bp, E. coli
aataacgatgatccgaccactggcg

SEQ ID NO: 223769 - DNA, 25 bp, E. coli
tattgatgaagaaggcgtctgccgc

SEQ ID NO: 223770 - DNA, 25 bp, E. coli
tattgatgaagatggcgtctgccgc

SEQ ID NO: 223771 - DNA, 25 bp, E. coli
gaaggcatgagtttctccgaggcga

SEQ ID NO: 223772 - DNA, 25 bp, E. coli
gaaggcatgagtatctccgaggcga

SEQ ID NO: 223773 - DNA, 25 bp, E. coli
gaagttcggcggtacatcagtggca

SEQ ID NO: 223774 - DNA, 25 bp, E. coli
gaatatcatctgctgaacccggtca

SEQ ID NO: 223775 - DNA, 25 bp, E. coli
gaattaccggtctagggcatttcca

SEQ ID NO: 223776 - DNA, 25 bp, E. coli
gaattaccggtcaagggcatttcca

SEQ ID NO: 223777 - DNA, 25 bp, E. coli
gaatatcatctggtgaacccggtca

SEQ ID NO: 223778 - DNA, 25 bp, E. coli
gaagttcggcggaacatcagtggca

SEQ ID NO: 223779 - DNA, 25 bp, E. coli
gaaattgaacctgtgctgcccgcag

SEQ ID NO: 223780 - DNA, 25 bp, E. coli
gaaattgaacctctgctgcccgcag

SEQ ID NO: 223781 - DNA, 25 bp, E. coli
cgtctgccgcgtgaagattgccgaa

SEQ ID NO: 223782 - DNA, 25 bp, E. coli
cgtctgccgcgtcaagattgccgaa

SEQ ID NO: 223783 - DNA, 25 bp, E. coli
gattgaaaaaaccattagcggccag

SEQ ID NO: 223784 - DNA, 25 bp, E. coli
gatcaatatgcccacttcctgcgcg

SEQ ID NO: 223785 - DNA, 25 bp, E. coli
gattgaaaaaacgattagcggccag

SEQ ID NO: 223786 - DNA, 25 bp, E. coli
gatcaatatgccgacttcctgcgcg

SEQ ID NO: 223787 - DNA, 25 bp, E. coli
gatccggtcgaataactgctggcag

SEQ ID NO: 223788 - DNA, 25 bp, E. coli
gatccggtcgaaaaactgctggcag

SEQ ID NO: 223789 - DNA, 25 bp, E. coli
agtctatgcctcactaccacgttag

SEQ ID NO: 223790 - DNA, 25 bp, E. coli
agtctatgcctctctaccacgttag

SEQ ID NO: 223791 - DNA, 25 bp, E. coli
aaaaatgaactttacgtgctgaacg

SEQ ID NO: 223792 - DNA, 25 bp, E. coli
aaaaatgaacttaacgtgctgaacg

SEQ ID NO: 223793 - DNA, 25 bp, E. coli
tatgactgagaatgatataaactgg

SEQ ID NO: 223794 - DNA, 25 bp, E. coli
tatgactgagaaagatataaactgg

SEQ ID NO: 223795 - DNA, 25 bp, E. coli
tattattgaggatagcgggcataag

SEQ ID NO: 223796 - DNA, 25 bp, E. coli
tattattgaggaaagcgggcataag

SEQ ID NO: 223797 - DNA, 25 bp, E. coli
tcgatcgcacacaatccataaggca

SEQ ID NO: 223798 - DNA, 25 bp, E. coli
tcgatcgcacactatccataaggca

SEQ ID NO: 223799 - DNA, 25 bp, E. coli
ccataaggcaaataccaggattcgg

SEQ ID NO: 223800 - DNA, 25 bp, E. coli
ccacgttagtgaaaagggatacaat

SEQ ID NO: 223801 - DNA, 25 bp, E. coli
ccaggattcggtaatgttgttaata

SEQ ID NO: 223802 - DNA, 25 bp, E. coli
ccaggattcggttatgttgttaata

SEQ ID NO: 223803 - DNA, 25 bp, E. coli
ccataaggcaaaaaccaggattcgg

SEQ ID NO: 223804 - DNA, 25 bp, E. coli
ccacgttagtgataagggatacaat

SEQ ID NO: 223805 - DNA, 25 bp, E. coli
gggatacaatctcgtgcaacgtgag

SEQ ID NO: 223806 - DNA, 25 bp, E. coli
ggtacagaatatcgtgatcactaaa

SEQ ID NO: 223807 - DNA, 25 bp, E. coli
gggatacaatctggtgcaacgtgag

SEQ ID NO: 223808 - DNA, 25 bp, E. coli
ggtacagaatatggtgatcactaaa

SEQ ID NO: 223809 - DNA, 25 bp, E. coli
ggaactggatgattctcgatcgcac

SEQ ID NO: 223810 - DNA, 25 bp, E. coli
ggaactggatgaatctcgatcgcac

SEQ ID NO: 223811 - DNA, 25 bp, E. coli
aacgatgtctaattattcctctgaa

SEQ ID NO: 223812 - DNA, 25 bp, E. coli
ccctacagatttataagaaagcctt

SEQ ID NO: 223813 - DNA, 25 bp, E. coli
ccctacagatttttaagaaagcctt

SEQ ID NO: 223814 - DNA, 25 bp, E. coli
aacgatgtctaaatattcctctgaa

SEQ ID NO: 223815 - DNA, 25 bp, E. coli
tatcgggttatttgtctgctgacag

SEQ ID NO: 223816 - DNA, 25 bp, E. coli
tatcgggttattagtctgctgacag

SEQ ID NO: 223817 - DNA, 25 bp, E. coli
tgtttcgattggtataacgatgtct

SEQ ID NO: 223818 - DNA, 25 bp, E. coli
tgtttcgattggaataacgatgtct

SEQ ID NO: 223819 - DNA, 25 bp, E. coli
tgctcatccttgatttatcgggtta

SEQ ID NO: 223820 - DNA, 25 bp, E. coli
tgctcatccttgttttatcgggtta

SEQ ID NO: 223821 - DNA, 25 bp, E. coli
tcctgatacaaaaaaccgccagcgt

SEQ ID NO: 223822 - DNA, 25 bp, E. coli
tcctctgaacatgttcctgatacaa

SEQ ID NO: 223823 - DNA, 25 bp, E. coli
tcctctgaacatcttcctgatacaa

SEQ ID NO: 223824 - DNA, 25 bp, E. coli
tcctgatacaaataaccgccagcgt

SEQ ID NO: 223825 - DNA, 25 bp, E. coli
tctgtcagataagaacaattaggaa

SEQ ID NO: 223826 - DNA, 25 bp, E. coli
tctgtcagataacaacaattaggaa

SEQ ID NO: 223827 - DNA, 25 bp, E. coli
gctgacaggcgaaaccctacagatt

SEQ ID NO: 223828 - DNA, 25 bp, E. coli
gctgacaggcgataccctacagatt

SEQ ID NO: 223829 - DNA, 25 bp, E. coli
gaaagccttaagagagatatctgtc

SEQ ID NO: 223830 - DNA, 25 bp, E. coli
gaaagccttaagtgagatatctgtc

SEQ ID NO: 223831 - DNA, 25 bp, E. coli
ccgctggcggttatcaatgtattca

SEQ ID NO: 223832 - DNA, 25 bp, E. coli
ccgctggcggttttcaatgtattca

SEQ ID NO: 223833 - DNA, 25 bp, E. coli
caaactctaattatcccaatcggga

SEQ ID NO: 223834 - DNA, 25 bp, E. coli
caaactctaattttcccaatcggga

SEQ ID NO: 223835 - DNA, 25 bp, E. coli
caatcgggaacagagatattgcggc

SEQ ID NO: 223836 - DNA, 25 bp, E. coli
caatcgggaacacagatattgcggc

SEQ ID NO: 223837 - DNA, 25 bp, E. coli
tttggtacccatctgaatgatacgg

SEQ ID NO: 223838 - DNA, 25 bp, E. coli
tttggtacccatgtgaatgatacgg

SEQ ID NO: 223839 - DNA, 25 bp, E. coli
acgaaccgaggaattgacaaagcaa

SEQ ID NO: 223840 - DNA, 25 bp, E. coli
acgaaccgaggatttgacaaagcaa

SEQ ID NO: 223841 - DNA, 25 bp, E. coli
acaaagcaatgctgcgccaacgtct

SEQ ID NO: 223842 - DNA, 25 bp, E. coli
acaaagcaatgcagcgccaacgtct

SEQ ID NO: 223843 - DNA, 25 bp, E. coli
taggcccgaaatgacgctttagcgt

SEQ ID NO: 223844 - DNA, 25 bp, E. coli
taggcccgaaatcacgctttagcgt

SEQ ID NO: 223845 - DNA, 25 bp, E. coli
tcgcatcgggcattctacaaaagag

SEQ ID NO: 223846 - DNA, 25 bp, E. coli
tcgcatcgggcaatctacaaaagag

SEQ ID NO: 223847 - DNA, 25 bp, E. coli
gcacatgttcaacgtaggcccgaaa

SEQ ID NO: 223848 - DNA, 25 bp, E. coli
gcacatgttcaaggtaggcccgaaa

SEQ ID NO: 223849 - DNA, 25 bp, E. coli
gatattgcggcagcacgactgatac

SEQ ID NO: 223850 - DNA, 25 bp, E. coli
gatattgcggcaccacgactgatac

SEQ ID NO: 223851 - DNA, 25 bp, E. coli
taacatctggcgtttgagaatcacc

SEQ ID NO: 223852 - DNA, 25 bp, E. coli
taacatctggcgattgagaatcacc

SEQ ID NO: 223853 - DNA, 25 bp, E. coli
gatgtcaggagtatgtttggtaccc

SEQ ID NO: 223854 - DNA, 25 bp, E. coli
gatgtcaggagtttgtttggtaccc

SEQ ID NO: 223855 - DNA, 25 bp, E. coli
aattaccgcttaggccgatggtggg

SEQ ID NO: 223856 - DNA, 25 bp, E. coli
aattaccgcttacgccgatggtggg

SEQ ID NO: 223857 - DNA, 25 bp, E. coli
catttcattacccatgaagatgtcg

SEQ ID NO: 223858 - DNA, 25 bp, E. coli
catttcattaccgatgaagatgtcg

SEQ ID NO: 223859 - DNA, 25 bp, E. coli
tttatgcatccggtgttggaacgtc

SEQ ID NO: 223860 - DNA, 25 bp, E. coli
tttatgcatccgctgttggaacgtc

SEQ ID NO: 223861 - DNA, 25 bp, E. coli
tcgcaaaaagtggagcacggtgaat

SEQ ID NO: 223862 - DNA, 25 bp, E. coli
tcgcaaaaagtgcagcacggtgaat

SEQ ID NO: 223863 - DNA, 25 bp, E. coli
tctcgccacggaaattgtgctgacc

SEQ ID NO: 223864 - DNA, 25 bp, E. coli
tctcgccacggatattgtgctgacc

SEQ ID NO: 223865 - DNA, 25 bp, E. coli
gcgctgatttaccttgtcaggatgc

SEQ ID NO: 223866 - DNA, 25 bp, E. coli
gcgctgatttacgttgtcaggatgc

SEQ ID NO: 223867 - DNA, 25 bp, E. coli
gcagcacggtgattttggactcaat

SEQ ID NO: 223868 - DNA, 25 bp, E. coli
gcagcacggtgaatttggactcaat

SEQ ID NO: 223869 - DNA, 25 bp, E. coli
cattactggtgaagttccttgctga

SEQ ID NO: 223870 - DNA, 25 bp, E. coli
cattactggtgatgttccttgctga

SEQ ID NO: 223871 - DNA, 25 bp, E. coli
ggactcaatgattttctcgccacgg

SEQ ID NO: 223872 - DNA, 25 bp, E. coli
ggactcaatgatattctcgccacgg

SEQ ID NO: 223873 - DNA, 25 bp, E. coli
tggaacgtcgcacattagcgctgat

SEQ ID NO: 223874 - DNA, 25 bp, E. coli
tggaacgtcgcagattagcgctgat

SEQ ID NO: 223875 - DNA, 25 bp, E. coli
gatgttccttgcagatggcgcaggc

SEQ ID NO: 223876 - DNA, 25 bp, E. coli
gatgttccttgctgatggcgcaggc

SEQ ID NO: 223877 - DNA, 25 bp, E. coli
aatgtgcaacttgtccaatgatctg

SEQ ID NO: 223878 - DNA, 25 bp, E. coli
aatgtgcaacttctccaatgatctg

SEQ ID NO: 223879 - DNA, 25 bp, E. coli
gagtaaagttcaccgccgaaaattg

SEQ ID NO: 223880 - DNA, 25 bp, E. coli
gagtaaagttcagcgccgaaaattg

SEQ ID NO: 223881 - DNA, 25 bp, E. coli
aaaagcacccatactcaggagcact

SEQ ID NO: 223882 - DNA, 25 bp, E. coli
aaaagcacccattctcaggagcact

SEQ ID NO: 223883 - DNA, 25 bp, E. coli
tagccgtcaaacaaattggcactga

SEQ ID NO: 223884 - DNA, 25 bp, E. coli
tagccgtcaaactaattggcactga

SEQ ID NO: 223885 - DNA, 25 bp, E. coli
ttagatgccctgtacacggcgaggc

SEQ ID NO: 223886 - DNA, 25 bp, E. coli
ttagatgccctgaacacggcgaggc

SEQ ID NO: 223887 - DNA, 25 bp, E. coli
tgaagttgaaacctgatagccgtca

SEQ ID NO: 223888 - DNA, 25 bp, E. coli
tgaagttgaaacgtgatagccgtca

SEQ ID NO: 223889 - DNA, 25 bp, E. coli
tctgtgtaataaataaagggcgctt

SEQ ID NO: 223890 - DNA, 25 bp, E. coli
tctgtgtaataattaaagggcgctt

SEQ ID NO: 223891 - DNA, 25 bp, E. coli
ccttgccacgcgtgagaacgtaaaa

SEQ ID NO: 223892 - DNA, 25 bp, E. coli
ccttgccacgcgagagaacgtaaaa

SEQ ID NO: 223893 - DNA, 25 bp, E. coli
gaaaattgggcgctgaataaccacg

SEQ ID NO: 223894 - DNA, 25 bp, E. coli
gaaaattgggcggtgaataaccacg

SEQ ID NO: 223895 - DNA, 25 bp, E. coli
tggctaaaacgagtaaagttcaccg

SEQ ID NO: 223896 - DNA, 25 bp, E. coli
tggctaaaacgactaaagttcaccg

SEQ ID NO: 223897 - DNA, 25 bp, E. coli
taaccacgtttgtaatattgtgaca

SEQ ID NO: 223898 - DNA, 25 bp, E. coli
taaccacgtttgaaatattgtgaca

SEQ ID NO: 223899 - DNA, 25 bp, E. coli
aatattgctgaagtgggcacccgcg

SEQ ID NO: 223900 - DNA, 25 bp, E. coli
aatattgctgaactgggcacccgcg

SEQ ID NO: 223901 - DNA, 25 bp, E. coli
cacggcttccgttcaatggcctgta

SEQ ID NO: 223902 - DNA, 25 bp, E. coli
cacggcttccgtacaatggcctgta

SEQ ID NO: 223903 - DNA, 25 bp, E. coli
cactaaggttgaagtttgcggccac

SEQ ID NO: 223904 - DNA, 25 bp, E. coli
cactaaggttgatgtttgcggccac

SEQ ID NO: 223905 - DNA, 25 bp, E. coli
cattttcaaagctggcgctggcgat

SEQ ID NO: 223906 - DNA, 25 bp, E. coli
cattttcaaagcaggcgctggcgat

SEQ ID NO: 223907 - DNA, 25 bp, E. coli
cacggtaaacagagcactacgggtg

SEQ ID NO: 223908 - DNA, 25 bp, E. coli
cacggtaaacagtgcactacgggtg

SEQ ID NO: 223909 - DNA, 25 bp, E. coli
tattcccggcgtcaaacattctcag

SEQ ID NO: 223910 - DNA, 25 bp, E. coli
tattggcgatcacgatccgcgtaag

SEQ ID NO: 223911 - DNA, 25 bp, E. coli
tattcccggcgtgaaacattctcag

SEQ ID NO: 223912 - DNA, 25 bp, E. coli
tattggcgatcaggatccgcgtaag

SEQ ID NO: 223913 - DNA, 25 bp, E. coli
ccggatgtttcggtggcagatgcca

SEQ ID NO: 223914 - DNA, 25 bp, E. coli
ccggatgtttcgctggcagatgcca

SEQ ID NO: 223915 - DNA, 25 bp, E. coli
gaaaatcgatgactacaccggcagg

SEQ ID NO: 223916 - DNA, 25 bp, E. coli
gaaaatcgatgagtacaccggcagg

SEQ ID NO: 223917 - DNA, 25 bp, E. coli
gtaagcccatgagcgaaaacacggt

SEQ ID NO: 223918 - DNA, 25 bp, E. coli
gtaagcccatgaccgaaaacacggt

SEQ ID NO: 223919 - DNA, 25 bp, E. coli
gaggatcaaagatgcgtacaccgca

SEQ ID NO: 223920 - DNA, 25 bp, E. coli
gaggatcaaagaagcgtacaccgca

SEQ ID NO: 223921 - DNA, 25 bp, E. coli
catacttgcccctggttgaatctgt

SEQ ID NO: 223922 - DNA, 25 bp, E. coli
catacttgccccaggttgaatctgt

SEQ ID NO: 223923 - DNA, 25 bp, E. coli
agtgactaccgcatccttgtgcggg

SEQ ID NO: 223924 - DNA, 25 bp, E. coli
agtgactaccgcttccttgtgcggg

SEQ ID NO: 223925 - DNA, 25 bp, E. coli
tatcgggcagtgactaccgcttcct

SEQ ID NO: 223926 - DNA, 25 bp, E. coli
tatgtaaagtccctatcgggcagtg

SEQ ID NO: 223927 - DNA, 25 bp, E. coli
tatgtaaagtccgtatcgggcagtg

SEQ ID NO: 223928 - DNA, 25 bp, E. coli
tatcgggcagtgtctaccgcttcct

SEQ ID NO: 223929 - DNA, 25 bp, E. coli
tccgtatcgggctgtgactaccgct

SEQ ID NO: 223930 - DNA, 25 bp, E. coli
tccgtatcgggcagtgactaccgct

SEQ ID NO: 223931 - DNA, 25 bp, E. coli
tgcccctggttgtatctgttaaatg

SEQ ID NO: 223932 - DNA, 25 bp, E. coli
tgcccctggttgaatctgttaaatg

SEQ ID NO: 223933 - DNA, 25 bp, E. coli
gtaaagtccgtaacgggcagtgact

SEQ ID NO: 223934 - DNA, 25 bp, E. coli
gtaaagtccgtatcgggcagtgact

SEQ ID NO: 223935 - DNA, 25 bp, E. coli
gttgaatctgttaaatggacccctc

SEQ ID NO: 223936 - DNA, 25 bp, E. coli
gttgaatctgtttaatggacccctc

SEQ ID NO: 223937 - DNA, 25 bp, E. coli
gggcagtgactaccgcttccttgtg

SEQ ID NO: 223938 - DNA, 25 bp, E. coli
gggcagtgactagcgcttccttgtg

SEQ ID NO: 223939 - DNA, 25 bp, E. coli
gagttatgtaaagtccgtatcgggc

SEQ ID NO: 223940 - DNA, 25 bp, E. coli
gatgctttaccatacttgcccctgg

SEQ ID NO: 223941 - DNA, 25 bp, E. coli
gagttatgtaaactccgtatcgggc

SEQ ID NO: 223942 - DNA, 25 bp, E. coli
gatgctttaccaaacttgcccctgg

SEQ ID NO: 223943 - DNA, 25 bp, E. coli
cacaatctggtaaccgtgacggtga

SEQ ID NO: 223944 - DNA, 25 bp, E. coli
cacaatctggtatccgtgacggtga

SEQ ID NO: 223945 - DNA, 25 bp, E. coli
caaattccgagccaggaacagatcg

SEQ ID NO: 223946 - DNA, 25 bp, E. coli
caaattccgagcgaggaacagatcg

SEQ ID NO: 223947 - DNA, 25 bp, E. coli
cttgatggagcaggaagggatttcc

SEQ ID NO: 223948 - DNA, 25 bp, E. coli
cttgatggagcacgaagggatttcc

SEQ ID NO: 223949 - DNA, 25 bp, E. coli
agggatttcccgctatctggtgtcg

SEQ ID NO: 223950 - DNA, 25 bp, E. coli
agggatttcccggtatctggtgtcg

SEQ ID NO: 223951 - DNA, 25 bp, E. coli
tataaaaaagataccgcgctgatgc

SEQ ID NO: 223952 - DNA, 25 bp, E. coli
tataaaaaagattccgcgctgatgc

SEQ ID NO: 223953 - DNA, 25 bp, E. coli
gccgtggcgggtagcgattcaaaaa

SEQ ID NO: 223954 - DNA, 25 bp, E. coli
gccgtggcgggttgcgattcaaaaa

SEQ ID NO: 223955 - DNA, 25 bp, E. coli
gaagcgatggccgatatcgtcacca

SEQ ID NO: 223956 - DNA, 25 bp, E. coli
gaagcgatggcccatatcgtcacca

SEQ ID NO: 223957 - DNA, 25 bp, E. coli
gacgccgacgatcagctgctttcga

SEQ ID NO: 223958 - DNA, 25 bp, E. coli
gggcgtcccatccaacacaatctgg

SEQ ID NO: 223959 - DNA, 25 bp, E. coli
gggcgtcccatcgaacacaatctgg

SEQ ID NO: 223960 - DNA, 25 bp, E. coli
ggaaataagctttacccgcgtggca

SEQ ID NO: 223961 - DNA, 25 bp, E. coli
ggaaataagcttaacccgcgtggca

SEQ ID NO: 223962 - DNA, 25 bp, E. coli
taactattacgaactggacggcaaa

SEQ ID NO: 223963 - DNA, 25 bp, E. coli
taactattacgatctggacggcaaa

SEQ ID NO: 223964 - DNA, 25 bp, E. coli
gacgccgacgatgagctgctttcga

SEQ ID NO: 223965 - DNA, 25 bp, E. coli
gtccacaaacgggagagccggttat

SEQ ID NO: 223966 - DNA, 25 bp, E. coli
gtccacaaacggcagagccggttat

SEQ ID NO: 223967 - DNA, 25 bp, E. coli
atctgtcggtgtcaacgcgatgatc

SEQ ID NO: 223968 - DNA, 25 bp, E. coli
tgtaccgggtcctcaaacgggagag

SEQ ID NO: 223969 - DNA, 25 bp, E. coli
atctgtcggtgtgaacgcgatgatc

SEQ ID NO: 223970 - DNA, 25 bp, E. coli
tgtaccgggtccacaaacgggagag

SEQ ID NO: 223971 - DNA, 25 bp, E. coli
acaaacgggagagccggttattgct

SEQ ID NO: 223972 - DNA, 25 bp, E. coli
acaaacgggagacccggttattgct

SEQ ID NO: 223973 - DNA, 25 bp, E. coli
ttgcgccgcagccacaatatcagca

SEQ ID NO: 223974 - DNA, 25 bp, E. coli
ttgcgccgcagcgacaatatcagca

SEQ ID NO: 223975 - DNA, 25 bp, E. coli
tgccgacccggaggacgtcctattt

SEQ ID NO: 223976 - DNA, 25 bp, E. coli
tgccgacccggacgacgtcctattt

SEQ ID NO: 223977 - DNA, 25 bp, E. coli
tgcacctgcagcagaacaacctgcg

SEQ ID NO: 223978 - DNA, 25 bp, E. coli
tgcacctgcagctgaacaacctgcg

SEQ ID NO: 223979 - DNA, 25 bp, E. coli
tccggtaaatctgtcggtgtgaacg

SEQ ID NO: 223980 - DNA, 25 bp, E. coli
tccggtaaatctctcggtgtgaacg

SEQ ID NO: 223981 - DNA, 25 bp, E. coli
gcaacagccgtaatatgcccctgcg

SEQ ID NO: 223982 - DNA, 25 bp, E. coli
gcaacagccgtattatgcccctgcg

SEQ ID NO: 223983 - DNA, 25 bp, E. coli
gaacaacctgcggaacagccgtatt

SEQ ID NO: 223984 - DNA, 25 bp, E. coli
gaacaacctgcgcaacagccgtatt

SEQ ID NO: 223985 - DNA, 25 bp, E. coli
ccgacagcgaaagcgaaggtggtgc

SEQ ID NO: 223986 - DNA, 25 bp, E. coli
ccgacagcgaaaccgaaggtggtgc

SEQ ID NO: 223987 - DNA, 25 bp, E. coli
cataacctgtgggataggcaacgtt

SEQ ID NO: 223988 - DNA, 25 bp, E. coli
cataacctgtggcataggcaacgtt

SEQ ID NO: 223989 - DNA, 25 bp, E. coli
agttctgcgaaagcatcagtggcgg

SEQ ID NO: 223990 - DNA, 25 bp, E. coli
agttctgcgaaaccatcagtggcgg

SEQ ID NO: 223991 - DNA, 25 bp, E. coli
tagtgcgccccagcatgagatagat

SEQ ID NO: 223992 - DNA, 25 bp, E. coli
tagtgcgccccaccatgagatagat

SEQ ID NO: 223993 - DNA, 25 bp, E. coli
tataacgatctgaatggcaccaccc

SEQ ID NO: 223994 - DNA, 25 bp, E. coli
tatagcagtcaatctcagtggtcgg

SEQ ID NO: 223995 - DNA, 25 bp, E. coli
tataacgatctgtatggcaccaccc

SEQ ID NO: 223996 - DNA, 25 bp, E. coli
tatagcagtcaaactcagtggtcgg

SEQ ID NO: 223997 - DNA, 25 bp, E. coli
tgagcacattctcggtggaaccgcc

SEQ ID NO: 223998 - DNA, 25 bp, E. coli
tgagcacattctgggtggaaccgcc

SEQ ID NO: 223999 - DNA, 25 bp, E. coli
tctgaaagataagcgggcgacgcag

SEQ ID NO: 224000 - DNA, 25 bp, E. coli
tcacgtatggcgcagtttaacaagc

SEQ ID NO: 224001 - DNA, 25 bp, E. coli
tcacgtatggcggagtttaacaagc

SEQ ID NO: 224002 - DNA, 25 bp, E. coli
tctgaaagataaccgggcgacgcag

SEQ ID NO: 224003 - DNA, 25 bp, E. coli
ccaatgtgccgatgatgactgccga

SEQ ID NO: 224004 - DNA, 25 bp, E. coli
ccaatgtgccgaagatgactgccga

SEQ ID NO: 224005 - DNA, 25 bp, E. coli
cgtccggtgccctttatctgaaaga

SEQ ID NO: 224006 - DNA, 25 bp, E. coli
cgtccggtgcccattatctgaaaga

SEQ ID NO: 224007 - DNA, 25 bp, E. coli
gataacgagctattaccagggcatg

SEQ ID NO: 224008 - DNA, 25 bp, E. coli
gataacgagctaataccagggcatg

SEQ ID NO: 224009 - DNA, 25 bp, E. coli
catcgatacgatgattgcgcgcgcc

SEQ ID NO: 224010 - DNA, 25 bp, E. coli
catcgatacgatcattgcgcgcgcc

SEQ ID NO: 224011 - DNA, 25 bp, E. coli
tacgagaaataccaacacgctttgg

SEQ ID NO: 224012 - DNA, 25 bp, E. coli
tacaacttgtgggtacctggagtct

SEQ ID NO: 224013 - DNA, 25 bp, E. coli
tacaacttgtggctacctggagtct

SEQ ID NO: 224014 - DNA, 25 bp, E. coli
tacgagaaatacgaacacgctttgg

SEQ ID NO: 224015 - DNA, 25 bp, E. coli
cttccccgaaatgcaaaaggttctg

SEQ ID NO: 224016 - DNA, 25 bp, E. coli
cttccccgaaatccaaaaggttctg

SEQ ID NO: 224017 - DNA, 25 bp, E. coli
tatcgaactcgtgaggaggcaatgc

SEQ ID NO: 224018 - DNA, 25 bp, E. coli
tatcgaactcgtcaggaggcaatgc

SEQ ID NO: 224019 - DNA, 25 bp, E. coli
ttccgtctgggaaatctgtgggcga

SEQ ID NO: 224020 - DNA, 25 bp, E. coli
ttccgtctgggatatctgtgggcga

SEQ ID NO: 224021 - DNA, 25 bp, E. coli
gccctgcttgagacgctgatttacg

SEQ ID NO: 224022 - DNA, 25 bp, E. coli
gccctgcttgagtcgctgatttacg

SEQ ID NO: 224023 - DNA, 25 bp, E. coli
gaagtccagaaactcaccgtagagg

SEQ ID NO: 224024 - DNA, 25 bp, E. coli
gaagtccagaaagtcaccgtagagg

SEQ ID NO: 224025 - DNA, 25 bp, E. coli
gatcattctttcatgcagcgtcggc

SEQ ID NO: 224026 - DNA, 25 bp, E. coli
gattctcgaaccgtctgcgcatttg

SEQ ID NO: 224027 - DNA, 25 bp, E. coli
gatcattctttcttgcagcgtcggc

SEQ ID NO: 224028 - DNA, 25 bp, E. coli
gattctcgaaccctctgcgcatttg

SEQ ID NO: 224029 - DNA, 25 bp, E. coli
gatgccagacatgtcgttcccggtg

SEQ ID NO: 224030 - DNA, 25 bp, E. coli
gatgccagacatctcgttcccggtg

SEQ ID NO: 224031 - DNA, 25 bp, E. coli
cacatcataatcgtgggcttgctga

SEQ ID NO: 224032 - DNA, 25 bp, E. coli
cacatcataatcctgggcttgctga

SEQ ID NO: 224033 - DNA, 25 bp, E. coli
aaatgtattggcgagtaagaaccgc

SEQ ID NO: 224034 - DNA, 25 bp, E. coli
aaatgtattggccagtaagaaccgc

SEQ ID NO: 224035 - DNA, 25 bp, E. coli
tgttcccgcgcagttatcaaaagca

SEQ ID NO: 224036 - DNA, 25 bp, E. coli
tgttcccgcgcacttatcaaaagca

SEQ ID NO: 224037 - DNA, 25 bp, E. coli
gcatttggtactttccgggcaaccg

SEQ ID NO: 224038 - DNA, 25 bp, E. coli
gcatttggtactatccgggcaaccg

SEQ ID NO: 224039 - DNA, 25 bp, E. coli
gaaagtctccgagcctgtgcagggt

SEQ ID NO: 224040 - DNA, 25 bp, E. coli
gaaagtctccgaccctgtgcagggt

SEQ ID NO: 224041 - DNA, 25 bp, E. coli
cgggcaaccgcctgacgattcttta

SEQ ID NO: 224042 - DNA, 25 bp, E. coli
cgggcaaccgccagacgattcttta

SEQ ID NO: 224043 - DNA, 25 bp, E. coli
gggagacacagttcgaatcgacata

SEQ ID NO: 224044 - DNA, 25 bp, E. coli
gggagacacagtacgaatcgacata

SEQ ID NO: 224045 - DNA, 25 bp, E. coli
tcaaatgaaacggagctgccatgct

SEQ ID NO: 224046 - DNA, 25 bp, E. coli
taattaacaattaaagagcgtcgcg

SEQ ID NO: 224047 - DNA, 25 bp, E. coli
taattaacaatttaagagcgtcgcg

SEQ ID NO: 224048 - DNA, 25 bp, E. coli
taacgataaagttacctgacagcag

SEQ ID NO: 224049 - DNA, 25 bp, E. coli
taacgataaagtaacctgacagcag

SEQ ID NO: 224050 - DNA, 25 bp, E. coli
tcaaatgaaacgcagctgccatgct

SEQ ID NO: 224051 - DNA, 25 bp, E. coli
gagcgtcgcgaaagaataatgtgtc

SEQ ID NO: 224052 - DNA, 25 bp, E. coli
gagcgtcgcgaatgaataatgtgtc

SEQ ID NO: 224053 - DNA, 25 bp, E. coli
taacaaaccggccacattgagcact

SEQ ID NO: 224054 - DNA, 25 bp, E. coli
taacaaaccggcgacattgagcact

SEQ ID NO: 224055 - DNA, 25 bp, E. coli
taccagaatactaaagcccgggcga

SEQ ID NO: 224056 - DNA, 25 bp, E. coli
taccagaatacttaagcccgggcga

SEQ ID NO: 224057 - DNA, 25 bp, E. coli
tatggataaagaagactataccccg

SEQ ID NO: 224058 - DNA, 25 bp, E. coli
tatggataaagatgactataccccg

SEQ ID NO: 224059 - DNA, 25 bp, E. coli
tgagctgccgcagaccgttgatctg

SEQ ID NO: 224060 - DNA, 25 bp, E. coli
tgagctgccgcacaccgttgatctg

SEQ ID NO: 224061 - DNA, 25 bp, E. coli
tcgtatccatatcgaagaacgccgt

SEQ ID NO: 224062 - DNA, 25 bp, E. coli
tcgtatccatatggaagaacgccgt

SEQ ID NO: 224063 - DNA, 25 bp, E. coli
tctgatgtccgtaccgggctgaaag

SEQ ID NO: 224064 - DNA, 25 bp, E. coli
tctgatgtccgttccgggctgaaag

SEQ ID NO: 224065 - DNA, 25 bp, E. coli
gcactggtctggagattcaggtacc

SEQ ID NO: 224066 - DNA, 25 bp, E. coli
gcggtgccgctaggctgtacaaaat

SEQ ID NO: 224067 - DNA, 25 bp, E. coli
gcactggtctggtgattcaggtacc

SEQ ID NO: 224068 - DNA, 25 bp, E. coli
gcggtgccgctacgctgtacaaaat

SEQ ID NO: 224069 - DNA, 25 bp, E. coli
gaattacaacggcaaactgctgctg

SEQ ID NO: 224070 - DNA, 25 bp, E. coli
gaattacaacgggaaactgctgctg

SEQ ID NO: 224071 - DNA, 25 bp, E. coli
gacttctcctatctcgatggcaacg

SEQ ID NO: 224072 - DNA, 25 bp, E. coli
gacttctcctatgtcgatggcaacg

SEQ ID NO: 224073 - DNA, 25 bp, E. coli
gatgatatcgttcacaccgtgacgc

SEQ ID NO: 224074 - DNA, 25 bp, E. coli
gatgatatcgttgacaccgtgacgc

SEQ ID NO: 224075 - DNA, 25 bp, E. coli
caccaggtctggcagattgaaatct

SEQ ID NO: 224076 - DNA, 25 bp, E. coli
caccaggtctgggagattgaaatct

SEQ ID NO: 224077 - DNA, 25 bp, E. coli
aaagggcgtttgtgctgttcgtcac

SEQ ID NO: 224078 - DNA, 25 bp, E. coli
aaagggcgtttgagctgttcgtcac

SEQ ID NO: 224079 - DNA, 25 bp, E. coli
ttgcatctcggtacgcgtcaccagg

SEQ ID NO: 224080 - DNA, 25 bp, E. coli
ttgaagcgacaaagccagtagactc

SEQ ID NO: 224081 - DNA, 25 bp, E. coli
ttgcatctcggttcgcgtcaccagg

SEQ ID NO: 224082 - DNA, 25 bp, E. coli
ttgaagcgacaatgccagtagactc

SEQ ID NO: 224083 - DNA, 25 bp, E. coli
tgcgcggcgtatccaaaccgttgca

SEQ ID NO: 224084 - DNA, 25 bp, E. coli
tgcgcggcgtatgcaaaccgttgca

SEQ ID NO: 224085 - DNA, 25 bp, E. coli
gcatccgtggtactggccgaaagta

SEQ ID NO: 224086 - DNA, 25 bp, E. coli
gcatccgtggtagtggccgaaagta

SEQ ID NO: 224087 - DNA, 25 bp, E. coli
cgctttgaacatattggtgatgaca

SEQ ID NO: 224088 - DNA, 25 bp, E. coli
cgctttgaacattttggtgatgaca

SEQ ID NO: 224089 - DNA, 25 bp, E. coli
tgtaccgaaggtgagcaaaaagtgg

SEQ ID NO: 224090 - DNA, 25 bp, E. coli
ggttggtctggatatcaatgctaac

SEQ ID NO: 224091 - DNA, 25 bp, E. coli
tgtaccgaaggtcagcaaaaagtgg

SEQ ID NO: 224092 - DNA, 25 bp, E. coli
ggttggtctggaaatcaatgctaac

SEQ ID NO: 224093 - DNA, 25 bp, E. coli
ggtgatgacaccgttgaagcgacaa

SEQ ID NO: 224094 - DNA, 25 bp, E. coli
ggtgatgacacccttgaagcgacaa

SEQ ID NO: 224095 - DNA, 25 bp, E. coli
ggacaaagcagcgtttcgggttgct

SEQ ID NO: 224096 - DNA, 25 bp, E. coli
ggacaaagcagcctttcgggttgct

SEQ ID NO: 224097 - DNA, 25 bp, E. coli
caggctgcagtaatttccaaaacgg

SEQ ID NO: 224098 - DNA, 25 bp, E. coli
caggctgcagtattttccaaaacgg

SEQ ID NO: 224099 - DNA, 25 bp, E. coli
tactgccgagaataatcaagaactg

SEQ ID NO: 224100 - DNA, 25 bp, E. coli
tactgccgagaaaaatcaagaactg

SEQ ID NO: 224101 - DNA, 25 bp, E. coli
acgcgggccgcgtgatgttaaagat

SEQ ID NO: 224102 - DNA, 25 bp, E. coli
atgagtacgcctcatttttctactg

SEQ ID NO: 224103 - DNA, 25 bp, E. coli
acgcgggccgcgagatgttaaagat

SEQ ID NO: 224104 - DNA, 25 bp, E. coli
atgagtacgcctgatttttctactg

SEQ ID NO: 224105 - DNA, 25 bp, E. coli
aaatgaagtctcgtgcctgaaagcg

SEQ ID NO: 224106 - DNA, 25 bp, E. coli
aaatgaagtctcctgcctgaaagcg

SEQ ID NO: 224107 - DNA, 25 bp, E. coli
acagcttgcgctgatcgaagacgaa

SEQ ID NO: 224108 - DNA, 25 bp, E. coli
acagcttgcgctcatcgaagacgaa

SEQ ID NO: 224109 - DNA, 25 bp, E. coli
tgatcgaagacgaaacccaggctgc

SEQ ID NO: 224110 - DNA, 25 bp, E. coli
tgatcgaagacgtaacccaggctgc

SEQ ID NO: 224111 - DNA, 25 bp, E. coli
tgctgacgctgatgctgcaggcgat

SEQ ID NO: 224112 - DNA, 25 bp, E. coli
tgctgacgctgaagctgcaggcgat

SEQ ID NO: 224113 - DNA, 25 bp, E. coli
tctcctgcctgatagcgatgctgac

SEQ ID NO: 224114 - DNA, 25 bp, E. coli
tctcctgcctgaaagcgatgctgac

SEQ ID NO: 224115 - DNA, 25 bp, E. coli
gcaaattaaacatgcctaccgtcag

SEQ ID NO: 224116 - DNA, 25 bp, E. coli
gcaaattaaacaagcctaccgtcag

SEQ ID NO: 224117 - DNA, 25 bp, E. coli
tcaagaactggctaatgaagtctcc

SEQ ID NO: 224118 - DNA, 25 bp, E. coli
tcaagaactggcaaatgaagtctcc

SEQ ID NO: 224119 - DNA, 25 bp, E. coli
caaaggtacgctgatcgacggtaaa

SEQ ID NO: 224120 - DNA, 25 bp, E. coli
caaagccggaaggtgatgcgaaagc

SEQ ID NO: 224121 - DNA, 25 bp, E. coli
cagaactggcttacggcaaagcggg

SEQ ID NO: 224122 - DNA, 25 bp, E. coli
caaagccggaagctgatgcgaaagc

SEQ ID NO: 224123 - DNA, 25 bp, E. coli
caaaggtacgctcatcgacggtaaa

SEQ ID NO: 224124 - DNA, 25 bp, E. coli
cagaactggctttcggcaaagcggg

SEQ ID NO: 224125 - DNA, 25 bp, E. coli
taaagtaacgctcctggcgaccaca

SEQ ID NO: 224126 - DNA, 25 bp, E. coli
taaagtaacgctgctggcgaccaca

SEQ ID NO: 224127 - DNA, 25 bp, E. coli
tatcccgggttggacagaaggtctg

SEQ ID NO: 224128 - DNA, 25 bp, E. coli
tatcccgggttgcacagaaggtctg

SEQ ID NO: 224129 - DNA, 25 bp, E. coli
tctgaagaacatgaagaaaggcggt

SEQ ID NO: 224130 - DNA, 25 bp, E. coli
tctgaagaacatcaagaaaggcggt

SEQ ID NO: 224131 - DNA, 25 bp, E. coli
gcgtgaagtcttctgctcaggcgaa

SEQ ID NO: 224132 - DNA, 25 bp, E. coli
gcgtgaagtcttgtgctcaggcgaa

SEQ ID NO: 224133 - DNA, 25 bp, E. coli
cgctgggtcgttacatggaaaactc

SEQ ID NO: 224134 - DNA, 25 bp, E. coli
cgctgggtcgtttcatggaaaactc

SEQ ID NO: 224135 - DNA, 25 bp, E. coli
gttcgacaactcttacacccgtggt

SEQ ID NO: 224136 - DNA, 25 bp, E. coli
gttcgacaactcatacacccgtggt

SEQ ID NO: 224137 - DNA, 25 bp, E. coli
gagtaccgcgagtaatttgccaaag

SEQ ID NO: 224138 - DNA, 25 bp, E. coli
gagtaccgcgagaaatttgccaaag

SEQ ID NO: 224139 - DNA, 25 bp, E. coli
gatgtgaaaccagcgccgaaggctg

SEQ ID NO: 224140 - DNA, 25 bp, E. coli
gatgtgaaaccaccgccgaaggctg

SEQ ID NO: 224141 - DNA, 25 bp, E. coli
tactatgcgaaatggaacaccgggc

SEQ ID NO: 224142 - DNA, 25 bp, E. coli
taaaccgacgttcatgagcgccacg

SEQ ID NO: 224143 - DNA, 25 bp, E. coli
tactatgcgaaaaggaacaccgggc

SEQ ID NO: 224144 - DNA, 25 bp, E. coli
taaagcgccgcagaatgttgacagc

SEQ ID NO: 224145 - DNA, 25 bp, E. coli
taaagcgccgcacaatgttgacagc

SEQ ID NO: 224146 - DNA, 25 bp, E. coli
taaaccgacgttgatgagcgccacg

SEQ ID NO: 224147 - DNA, 25 bp, E. coli
tatttagcgtctggcgtgcgtcagg

SEQ ID NO: 224148 - DNA, 25 bp, E. coli
tatttagcgtctcgcgtgcgtcagg

SEQ ID NO: 224149 - DNA, 25 bp, E. coli
ttagcgttcagggaacgatcgccgg

SEQ ID NO: 224150 - DNA, 25 bp, E. coli
ttagcgttcaggcaacgatcgccgg

SEQ ID NO: 224151 - DNA, 25 bp, E. coli
tcaggtaaacaagatccgctggcgt

SEQ ID NO: 224152 - DNA, 25 bp, E. coli
tcaggtaaacaacatccgctggcgt

SEQ ID NO: 224153 - DNA, 25 bp, E. coli
cgaaagagctgtggctaaccggcaa

SEQ ID NO: 224154 - DNA, 25 bp, E. coli
cgaaagagctgtcgctaaccggcaa

SEQ ID NO: 224155 - DNA, 25 bp, E. coli
cgtctggcgatgtaagcgggtaaca

SEQ ID NO: 224156 - DNA, 25 bp, E. coli
cgtctggcgatgaaagcgggtaaca

SEQ ID NO: 224157 - DNA, 25 bp, E. coli
gatttattgctggaacgcggacgtg

SEQ ID NO: 224158 - DNA, 25 bp, E. coli
gattttacccgtcaaatggcggcgg

SEQ ID NO: 224159 - DNA, 25 bp, E. coli
gattttacccgtgaaatggcggcgg

SEQ ID NO: 224160 - DNA, 25 bp, E. coli
gatttattgctgcaacgcggacgtg

SEQ ID NO: 224161 - DNA, 25 bp, E. coli
ggcaattgctggatccggaaacgaa

SEQ ID NO: 224162 - DNA, 25 bp, E. coli
ggcaattgctggttccggaaacgaa

SEQ ID NO: 224163 - DNA, 25 bp, E. coli
caactcacgaacaggcaacgctggt

SEQ ID NO: 224164 - DNA, 25 bp, E. coli
caactcacgaactggcaacgctggt

SEQ ID NO: 224165 - DNA, 25 bp, E. coli
aactccggatgtggctgagcctgga

SEQ ID NO: 224166 - DNA, 25 bp, E. coli
aaaaagatatctcctgcttcggcgg

SEQ ID NO: 224167 - DNA, 25 bp, E. coli
aactccggatgtcgctgagcctgga

SEQ ID NO: 224168 - DNA, 25 bp, E. coli
aaaaagatatctgctgcttcggcgg

SEQ ID NO: 224169 - DNA, 25 bp, E. coli
ttagcctagtggttgcctgcggtca

SEQ ID NO: 224170 - DNA, 25 bp, E. coli
ttagcctagtggatgcctgcggtca

SEQ ID NO: 224171 - DNA, 25 bp, E. coli
ttggtccgggaaatggcacagtcca

SEQ ID NO: 224172 - DNA, 25 bp, E. coli
ttggtccgggaattggcacagtcca

SEQ ID NO: 224173 - DNA, 25 bp, E. coli
ttggcaccacaataggcctggaccg

SEQ ID NO: 224174 - DNA, 25 bp, E. coli
ttggcaccacaaaaggcctggaccg

SEQ ID NO: 224175 - DNA, 25 bp, E. coli
tgaggaagatatgctcatcgcccgc

SEQ ID NO: 224176 - DNA, 25 bp, E. coli
tgagcctggaggtcagtgaactgct

SEQ ID NO: 224177 - DNA, 25 bp, E. coli
tgaggaagatatcctcatcgcccgc

SEQ ID NO: 224178 - DNA, 25 bp, E. coli
tgagcctggaggacagtgaactgct

SEQ ID NO: 224179 - DNA, 25 bp, E. coli
gaatgaggcttcactcgacaactgg

SEQ ID NO: 224180 - DNA, 25 bp, E. coli
gaatgaggcttctctcgacaactgg

SEQ ID NO: 224181 - DNA, 25 bp, E. coli
gattaacgaggctattgccacgcag

SEQ ID NO: 224182 - DNA, 25 bp, E. coli
gattaacgaggcaattgccacgcag

SEQ ID NO: 224183 - DNA, 25 bp, E. coli
tggaccgcggtagctctcaaaatgc

SEQ ID NO: 224184 - DNA, 25 bp, E. coli
tggaccgcggtacctctcaaaatgc

SEQ ID NO: 224185 - DNA, 25 bp, E. coli
acttgagttattcagtagtctcccc

SEQ ID NO: 224186 - DNA, 25 bp, E. coli
acttgagttattgagtagtctcccc

SEQ ID NO: 224187 - DNA, 25 bp, E. coli
tttcccctcgattataaaacttgag

SEQ ID NO: 224188 - DNA, 25 bp, E. coli
tttcccctcgataataaaacttgag

SEQ ID NO: 224189 - DNA, 25 bp, E. coli
tgtcactgaccttagttgaacattg

SEQ ID NO: 224190 - DNA, 25 bp, E. coli
tgtcactgacctaagttgaacattg

SEQ ID NO: 224191 - DNA, 25 bp, E. coli
cctttatggttgagggcgttttgct

SEQ ID NO: 224192 - DNA, 25 bp, E. coli
cctttatggttgtgggcgttttgct

SEQ ID NO: 224193 - DNA, 25 bp, E. coli
gcttttttagcggaatgtcactgac

SEQ ID NO: 224194 - DNA, 25 bp, E. coli
gcttttttagcgcaatgtcactgac

SEQ ID NO: 224195 - DNA, 25 bp, E. coli
gaacattgttttataacggatagcg

SEQ ID NO: 224196 - DNA, 25 bp, E. coli
gaacattgttttttaacggatagcg

SEQ ID NO: 224197 - DNA, 25 bp, E. coli
gttttgctatgaacgccatcaccat

SEQ ID NO: 224198 - DNA, 25 bp, E. coli
gttttgctatgatcgccatcaccat

SEQ ID NO: 224199 - DNA, 25 bp, E. coli
gtttttaacatcttaagcgccctcg

SEQ ID NO: 224200 - DNA, 25 bp, E. coli
gtttttaacatcataagcgccctcg

SEQ ID NO: 224201 - DNA, 25 bp, E. coli
tcacacccaaaagtgcctaacgaaa

SEQ ID NO: 224202 - DNA, 25 bp, E. coli
tcacacccaaaactgcctaacgaaa

SEQ ID NO: 224203 - DNA, 25 bp, E. coli
taagcgccctcgtcctttatggttg

SEQ ID NO: 224204 - DNA, 25 bp, E. coli
taagcgccctcgacctttatggttg

SEQ ID NO: 224205 - DNA, 25 bp, E. coli
tattcagtagtctcccctcttgcaa

SEQ ID NO: 224206 - DNA, 25 bp, E. coli
tattcagtagtcacccctcttgcaa

SEQ ID NO: 224207 - DNA, 25 bp, E. coli
caccgtttccctggtgtggatgaag

SEQ ID NO: 224208 - DNA, 25 bp, E. coli
caccgtttccctcgtgtggatgaag

SEQ ID NO: 224209 - DNA, 25 bp, E. coli
caggaactgttgcagcaggcattaa

SEQ ID NO: 224210 - DNA, 25 bp, E. coli
caggaactgttggagcaggcattaa

SEQ ID NO: 224211 - DNA, 25 bp, E. coli
cattaactcatcgtagtgccagcag

SEQ ID NO: 224212 - DNA, 25 bp, E. coli
taaaagcggtggttttcgtcgtgag

SEQ ID NO: 224213 - DNA, 25 bp, E. coli
tagcccaggcgataaacaaaaagat

SEQ ID NO: 224214 - DNA, 25 bp, E. coli
tagcccaggcgaaaaacaaaaagat

SEQ ID NO: 224215 - DNA, 25 bp, E. coli
tggttggcacagcttcaagccgtcg

SEQ ID NO: 224216 - DNA, 25 bp, E. coli
tctgagctacgtaatcgccaatgcg

SEQ ID NO: 224217 - DNA, 25 bp, E. coli
tctgagctacgttatcgccaatgcg

SEQ ID NO: 224218 - DNA, 25 bp, E. coli
ccgtcgtaaggcagagcaggctgcc

SEQ ID NO: 224219 - DNA, 25 bp, E. coli
ccgtcgtaaggctgagcaggctgcc

SEQ ID NO: 224220 - DNA, 25 bp, E. coli
cattaactcatcctagtgccagcag

SEQ ID NO: 224221 - DNA, 25 bp, E. coli
gtgagtcaattcacgccgacaccgt

SEQ ID NO: 224222 - DNA, 25 bp, E. coli
gtgagtcaattctcgccgacaccgt

SEQ ID NO: 224223 - DNA, 25 bp, E. coli
tggttggcacaggttcaagccgtcg

SEQ ID NO: 224224 - DNA, 25 bp, E. coli
taatcggcttcaacggaagctgggc

SEQ ID NO: 224225 - DNA, 25 bp, E. coli
taattggtggcgaattcctcgacag

SEQ ID NO: 224226 - DNA, 25 bp, E. coli
taatcggcttcatcggaagctgggc

SEQ ID NO: 224227 - DNA, 25 bp, E. coli
taattggtggcgtattcctcgacag

SEQ ID NO: 224228 - DNA, 25 bp, E. coli
taaaagcggtggatttcgtcgtgag

SEQ ID NO: 224229 - DNA, 25 bp, E. coli
catgacgattggtgcactctggacg

SEQ ID NO: 224230 - DNA, 25 bp, E. coli
catgacgattggagcactctggacg

SEQ ID NO: 224231 - DNA, 25 bp, E. coli
tacattgccgcaacgcttgaggcgt

SEQ ID NO: 224232 - DNA, 25 bp, E. coli
tacattgccgcatcgcttgaggcgt

SEQ ID NO: 224233 - DNA, 25 bp, E. coli
tatcgctcacctgtatgaaaatcgc

SEQ ID NO: 224234 - DNA, 25 bp, E. coli
tatcgctcacctctatgaaaatcgc

SEQ ID NO: 224235 - DNA, 25 bp, E. coli
ttgatgacgggctggagttcacgcc

SEQ ID NO: 224236 - DNA, 25 bp, E. coli
ttgatgacgggcaggagttcacgcc

SEQ ID NO: 224237 - DNA, 25 bp, E. coli
ccagatacacattggcaggcgcttt

SEQ ID NO: 224238 - DNA, 25 bp, E. coli
ccagatacacataggcaggcgcttt

SEQ ID NO: 224239 - DNA, 25 bp, E. coli
gcatcgatggcgtcgaggaagacca

SEQ ID NO: 224240 - DNA, 25 bp, E. coli
gcatcgatggcgacgaggaagacca

SEQ ID NO: 224241 - DNA, 25 bp, E. coli
gcaaaaacacgcctacccatgacga

SEQ ID NO: 224242 - DNA, 25 bp, E. coli
gcaaaaacacgcgtacccatgacga

SEQ ID NO: 224243 - DNA, 25 bp, E. coli
gaagtgaaactccattgccgcatcg

SEQ ID NO: 224244 - DNA, 25 bp, E. coli
gaagtgaaactcgattgccgcatcg

SEQ ID NO: 224245 - DNA, 25 bp, E. coli
gaaaatcgccagattgtcgcggata

SEQ ID NO: 224246 - DNA, 25 bp, E. coli
gaaaatcgccagtttgtcgcggata

SEQ ID NO: 224247 - DNA, 25 bp, E. coli
ggaagaccagtttatcagcggatac

SEQ ID NO: 224248 - DNA, 25 bp, E. coli
ggaagaccagttaatcagcggatac

SEQ ID NO: 224249 - DNA, 25 bp, E. coli
gagttcacgccacccataaagattg

SEQ ID NO: 224250 - DNA, 25 bp, E. coli
gagttcacgccagccataaagattg

SEQ ID NO: 224251 - DNA, 25 bp, E. coli
cagcattctgctacgggtcaggtga

SEQ ID NO: 224252 - DNA, 25 bp, E. coli
cagcattctgcttcgggtcaggtga

SEQ ID NO: 224253 - DNA, 25 bp, E. coli
catgttactggcgactcagcattct

SEQ ID NO: 224254 - DNA, 25 bp, E. coli
catgttactggccactcagcattct

SEQ ID NO: 224255 - DNA, 25 bp, E. coli
tactggcgactctgcattctgctac

SEQ ID NO: 224256 - DNA, 25 bp, E. coli
tactggcgactcagcattctgctac

SEQ ID NO: 224257 - DNA, 25 bp, E. coli
attctgctacggctcaggtgacgca

SEQ ID NO: 224258 - DNA, 25 bp, E. coli
attctgctacgggtcaggtgacgca

SEQ ID NO: 224259 - DNA, 25 bp, E. coli
ttctgctacgggtcaggtgacgcag

SEQ ID NO: 224260 - DNA, 25 bp, E. coli
ttctgctacgggacaggtgacgcag

SEQ ID NO: 224261 - DNA, 25 bp, E. coli
tgttactggcgactcagcattctgc

SEQ ID NO: 224262 - DNA, 25 bp, E. coli
tgttactggcgagtcagcattctgc

SEQ ID NO: 224263 - DNA, 25 bp, E. coli
gcgactcagcatactgctacgggtc

SEQ ID NO: 224264 - DNA, 25 bp, E. coli
gcgactcagcattctgctacgggtc

SEQ ID NO: 224265 - DNA, 25 bp, E. coli
gactcagcattctgctacgggtcag

SEQ ID NO: 224266 - DNA, 25 bp, E. coli
gactcagcattcagctacgggtcag

SEQ ID NO: 224267 - DNA, 25 bp, E. coli
ctcagcattctgctacgggtcaggt

SEQ ID NO: 224268 - DNA, 25 bp, E. coli
ctcagcattctggtacgggtcaggt

SEQ ID NO: 224269 - DNA, 25 bp, E. coli
gttactggcgactcagcattctgct

SEQ ID NO: 224270 - DNA, 25 bp, E. coli
gttactggcgacacagcattctgct

SEQ ID NO: 224271 - DNA, 25 bp, E. coli
tggcgactcagctttctgctacggg

SEQ ID NO: 224272 - DNA, 25 bp, E. coli
tggcgactcagcattctgctacggg

SEQ ID NO: 224273 - DNA, 25 bp, E. coli
taaagaggttgacgattacagggct

SEQ ID NO: 224274 - DNA, 25 bp, E. coli
taaagaggttgaggattacagggct

SEQ ID NO: 224275 - DNA, 25 bp, E. coli
aggctgacgcccaggagctgaagaa

SEQ ID NO: 224276 - DNA, 25 bp, E. coli
aggctgacgccctggagctgaagaa

SEQ ID NO: 224277 - DNA, 25 bp, E. coli
tattcttgacggcatccctctctca

SEQ ID NO: 224278 - DNA, 25 bp, E. coli
tattcttgacgggatccctctctca

SEQ ID NO: 224279 - DNA, 25 bp, E. coli
ttgaggattacagggctgccagcga

SEQ ID NO: 224280 - DNA, 25 bp, E. coli
ttgaggattacacggctgccagcga

SEQ ID NO: 224281 - DNA, 25 bp, E. coli
tgacgggatccctctctcagtacag

SEQ ID NO: 224282 - DNA, 25 bp, E. coli
tgacgcccaggagctgaagaatgcc

SEQ ID NO: 224283 - DNA, 25 bp, E. coli
tgacgcccaggacctgaagaatgcc

SEQ ID NO: 224284 - DNA, 25 bp, E. coli
tgacgggatcccactctcagtacag

SEQ ID NO: 224285 - DNA, 25 bp, E. coli
tgaaaaactccgtaaagaggttgag

SEQ ID NO: 224286 - DNA, 25 bp, E. coli
tgaaaaactccgaaaagaggttgag

SEQ ID NO: 224287 - DNA, 25 bp, E. coli
tcccttgcgtctccggaggtggtaa

SEQ ID NO: 224288 - DNA, 25 bp, E. coli
tcccttgcgtctgcggaggtggtaa

SEQ ID NO: 224289 - DNA, 25 bp, E. coli
tctctcagtacaccggcgttttccg

SEQ ID NO: 224290 - DNA, 25 bp, E. coli
tctctcagtacagcggcgttttccg

SEQ ID NO: 224291 - DNA, 25 bp, E. coli
tctccggaggtggtaagggcgttga

SEQ ID NO: 224292 - DNA, 25 bp, E. coli
tctccggaggtgctaagggcgttga

SEQ ID NO: 224293 - DNA, 25 bp, E. coli
gatatcgaaaatgaaaaactccgta

SEQ ID NO: 224294 - DNA, 25 bp, E. coli
gatatcgaaaatcaaaaactccgta

SEQ ID NO: 224295 - DNA, 25 bp, E. coli
cacgcgttgtgagtaacattgacag

SEQ ID NO: 224296 - DNA, 25 bp, E. coli
cacgcgttgtgactaacattgacag

SEQ ID NO: 224297 - DNA, 25 bp, E. coli
catatggtgagtccattctcgaacg

SEQ ID NO: 224298 - DNA, 25 bp, E. coli
catatggtgagtgcattctcgaacg

SEQ ID NO: 224299 - DNA, 25 bp, E. coli
taaaggcgattcgtttagtacgcag

SEQ ID NO: 224300 - DNA, 25 bp, E. coli
taaaggcgattcctttagtacgcag

SEQ ID NO: 224301 - DNA, 25 bp, E. coli
tatgtgcagtaattgcaggtgccga

SEQ ID NO: 224302 - DNA, 25 bp, E. coli
tatgtgcagtaaatgcaggtgccga

SEQ ID NO: 224303 - DNA, 25 bp, E. coli
tagtacgcaggacataagtcatgga

SEQ ID NO: 224304 - DNA, 25 bp, E. coli
tagtacgcaggagataagtcatgga

SEQ ID NO: 224305 - DNA, 25 bp, E. coli
tgcatattgtcagtaacgtaacgcc

SEQ ID NO: 224306 - DNA, 25 bp, E. coli
tgcatattgtcactaacgtaacgcc

SEQ ID NO: 224307 - DNA, 25 bp, E. coli
tgagattacagccattccagagttg

SEQ ID NO: 224308 - DNA, 25 bp, E. coli
tgagattacagcgattccagagttg

SEQ ID NO: 224309 - DNA, 25 bp, E. coli
tcgatgacaccattgcacgcgttgt

SEQ ID NO: 224310 - DNA, 25 bp, E. coli
tcgatgacaccaatgcacgcgttgt

SEQ ID NO: 224311 - DNA, 25 bp, E. coli
tcttctggcagtaaaaggcaatcag

SEQ ID NO: 224312 - DNA, 25 bp, E. coli
tcttctggcagttaaaggcaatcag

SEQ ID NO: 224313 - DNA, 25 bp, E. coli
gataatggcattgcggtcgatgaca

SEQ ID NO: 224314 - DNA, 25 bp, E. coli
gataatggcattccggtcgatgaca

SEQ ID NO: 224315 - DNA, 25 bp, E. coli
gggctgtcagaatgatatcgcttcg

SEQ ID NO: 224316 - DNA, 25 bp, E. coli
gggctgtcagaaagatatcgcttcg

SEQ ID NO: 224317 - DNA, 25 bp, E. coli
aatggcgcttctttcggcggtctga

SEQ ID NO: 224318 - DNA, 25 bp, E. coli
aatggcgcttctatcggcggtctga

SEQ ID NO: 224319 - DNA, 25 bp, E. coli
tttgggccgtaagctggtagaagta

SEQ ID NO: 224320 - DNA, 25 bp, E. coli
tttgggccgtaacctggtagaagta

SEQ ID NO: 224321 - DNA, 25 bp, E. coli
tctaaaacgttgcagacaaaggaca

SEQ ID NO: 224322 - DNA, 25 bp, E. coli
tgcggaactatcaaaaacgttgcag

SEQ ID NO: 224323 - DNA, 25 bp, E. coli
tctaaaacgttggagacaaaggaca

SEQ ID NO: 224324 - DNA, 25 bp, E. coli
tgcggaactatctaaaacgttgcag

SEQ ID NO: 224325 - DNA, 25 bp, E. coli
gcggcaccgggttatggcgcttcta

SEQ ID NO: 224326 - DNA, 25 bp, E. coli
gcggcaccgggtaatggcgcttcta

SEQ ID NO: 224327 - DNA, 25 bp, E. coli
gcagacaaaggagaaagcaatggca

SEQ ID NO: 224328 - DNA, 25 bp, E. coli
gcagacaaaggacaaagcaatggca

SEQ ID NO: 224329 - DNA, 25 bp, E. coli
gacacctgccatttccaatgccatt

SEQ ID NO: 224330 - DNA, 25 bp, E. coli
gacacctgccatatccaatgccatt

SEQ ID NO: 224331 - DNA, 25 bp, E. coli
gatcaccgcgcgtctgacggcggca

SEQ ID NO: 224332 - DNA, 25 bp, E. coli
gatcaccgcgcgactgacggcggca

SEQ ID NO: 224333 - DNA, 25 bp, E. coli
ggacaaagcaatggcaatccacaat

SEQ ID NO: 224334 - DNA, 25 bp, E. coli
tggtcaatgatttgggccgtaagct

SEQ ID NO: 224335 - DNA, 25 bp, E. coli
ggacaaagcaatcgcaatccacaat

SEQ ID NO: 224336 - DNA, 25 bp, E. coli
tggtcaatgattagggccgtaagct

SEQ ID NO: 224337 - DNA, 25 bp, E. coli
gagcctgcgttcttttccgtactgg

SEQ ID NO: 224338 - DNA, 25 bp, E. coli
gagcctgcgttcatttccgtactgg

SEQ ID NO: 224339 - DNA, 25 bp, E. coli
cacgctgattctggtcgatggacga

SEQ ID NO: 224340 - DNA, 25 bp, E. coli
cacgctgattctcgtcgatggacga

SEQ ID NO: 224341 - DNA, 25 bp, E. coli
tagtatctctcacggaacaccggca

SEQ ID NO: 224342 - DNA, 25 bp, E. coli
tagtatctctcagggaacaccggca

SEQ ID NO: 224343 - DNA, 25 bp, E. coli
tatacgggaaaagaaatctgggcag

SEQ ID NO: 224344 - DNA, 25 bp, E. coli
tatatcattgctccgggcattgccg

SEQ ID NO: 224345 - DNA, 25 bp, E. coli
tatacgggaaaacaaatctgggcag

SEQ ID NO: 224346 - DNA, 25 bp, E. coli
tatatcattgctgcgggcattgccg

SEQ ID NO: 224347 - DNA, 25 bp, E. coli
tggatttggaactctgacgcagggt

SEQ ID NO: 224348 - DNA, 25 bp, E. coli
cctcctgtggaagcaattgaacgca

SEQ ID NO: 224349 - DNA, 25 bp, E. coli
cctcctgtggaaccaattgaacgca

SEQ ID NO: 224350 - DNA, 25 bp, E. coli
gaaagtctcaatggcaagtcgctga

SEQ ID NO: 224351 - DNA, 25 bp, E. coli
gaaagtctcaatcgcaagtcgctga

SEQ ID NO: 224352 - DNA, 25 bp, E. coli
gaaatggtgctatggttccccgcgt

SEQ ID NO: 224353 - DNA, 25 bp, E. coli
gaaatggtgctaaggttccccgcgt

SEQ ID NO: 224354 - DNA, 25 bp, E. coli
cgcattgaagtgatccgtggcccta

SEQ ID NO: 224355 - DNA, 25 bp, E. coli
cgcattgaagtgttccgtggcccta

SEQ ID NO: 224356 - DNA, 25 bp, E. coli
gtacaaaagatccagtcaccgggtt

SEQ ID NO: 224357 - DNA, 25 bp, E. coli
gtacaaaagatcgagtcaccgggtt

SEQ ID NO: 224358 - DNA, 25 bp, E. coli
tggatttggaacactgacgcagggt

SEQ ID NO: 224359 - DNA, 25 bp, E. coli
taattcacgtagtcactgggtagca

SEQ ID NO: 224360 - DNA, 25 bp, E. coli
taattcacgtagacactgggtagca

SEQ ID NO: 224361 - DNA, 25 bp, E. coli
ttcgtcgacttccagcaacaaggtg

SEQ ID NO: 224362 - DNA, 25 bp, E. coli
taccacctggtactggaaagaaaat

SEQ ID NO: 224363 - DNA, 25 bp, E. coli
taccaggatttagtcagcagaacgc

SEQ ID NO: 224364 - DNA, 25 bp, E. coli
taccaggatttactcagcagaacgc

SEQ ID NO: 224365 - DNA, 25 bp, E. coli
ttcgtcgacttcgagcaacaaggtg

SEQ ID NO: 224366 - DNA, 25 bp, E. coli
taccacctggtagtggaaagaaaat

SEQ ID NO: 224367 - DNA, 25 bp, E. coli
tgctggatgcaacgcgaatttgact

SEQ ID NO: 224368 - DNA, 25 bp, E. coli
tgctggatgcaaggcgaatttgact

SEQ ID NO: 224369 - DNA, 25 bp, E. coli
tgcccacacgatgttcaggatatgc

SEQ ID NO: 224370 - DNA, 25 bp, E. coli
tgcccacacgatcttcaggatatgc

SEQ ID NO: 224371 - DNA, 25 bp, E. coli
gaatcatcaaactcagtacggcacc

SEQ ID NO: 224372 - DNA, 25 bp, E. coli
gcaattttgcagatttggcgcgaaa

SEQ ID NO: 224373 - DNA, 25 bp, E. coli
gcaattttgcagttttggcgcgaaa

SEQ ID NO: 224374 - DNA, 25 bp, E. coli
gaatcatcaaacacagtacggcacc

SEQ ID NO: 224375 - DNA, 25 bp, E. coli
gacatattcagaacggcacggagcc

SEQ ID NO: 224376 - DNA, 25 bp, E. coli
gacttaatgacctgtgactacgcgt

SEQ ID NO: 224377 - DNA, 25 bp, E. coli
gacttaatgaccagtgactacgcgt

SEQ ID NO: 224378 - DNA, 25 bp, E. coli
gacatattcagatcggcacggagcc

SEQ ID NO: 224379 - DNA, 25 bp, E. coli
gatttgcgcatacgcatcccggagg

SEQ ID NO: 224380 - DNA, 25 bp, E. coli
gatttgcgcataggcatcccggagg

SEQ ID NO: 224381 - DNA, 25 bp, E. coli
taagcacgggatattacggttcagc

SEQ ID NO: 224382 - DNA, 25 bp, E. coli
taagcacgggattttacggttcagc

SEQ ID NO: 224383 - DNA, 25 bp, E. coli
aagccatgcttctgggagataaatc

SEQ ID NO: 224384 - DNA, 25 bp, E. coli
aagccatgcttcagggagataaatc

SEQ ID NO: 224385 - DNA, 25 bp, E. coli
cagttgaagcattcgcaaaacgtgc

SEQ ID NO: 224386 - DNA, 25 bp, E. coli
cataggcagcttcgacgttcgagac

SEQ ID NO: 224387 - DNA, 25 bp, E. coli
cagttgaagcatacgcaaaacgtgc

SEQ ID NO: 224388 - DNA, 25 bp, E. coli
cataggcagcttggacgttcgagac

SEQ ID NO: 224389 - DNA, 25 bp, E. coli
ttatgctgaagggtggaacgactgc

SEQ ID NO: 224390 - DNA, 25 bp, E. coli
ttatgctgaaggctggaacgactgc

SEQ ID NO: 224391 - DNA, 25 bp, E. coli
tgtttaaccctgtcacagttgaagc

SEQ ID NO: 224392 - DNA, 25 bp, E. coli
tgtttaaccctgacacagttgaagc

SEQ ID NO: 224393 - DNA, 25 bp, E. coli
tgcctgataagtagccgcgtgaata

SEQ ID NO: 224394 - DNA, 25 bp, E. coli
tgcctgataagttgccgcgtgaata

SEQ ID NO: 224395 - DNA, 25 bp, E. coli
gaatgcggtgaaaacataatcctgt

SEQ ID NO: 224396 - DNA, 25 bp, E. coli
gaatgcggtgaatacataatcctgt

SEQ ID NO: 224397 - DNA, 25 bp, E. coli
gcaaaacgtgcggaaatatcaccta

SEQ ID NO: 224398 - DNA, 25 bp, E. coli
gcaaaacgtgcgcaaatatcaccta

SEQ ID NO: 224399 - DNA, 25 bp, E. coli
cgccagcgctggtagtgcctgataa

SEQ ID NO: 224400 - DNA, 25 bp, E. coli
cgcgtgaatacagaaacggttggcc

SEQ ID NO: 224401 - DNA, 25 bp, E. coli
cgcgtgaatacacaaacggttggcc

SEQ ID NO: 224402 - DNA, 25 bp, E. coli
cgccagcgctggaagtgcctgataa

SEQ ID NO: 224403 - DNA, 25 bp, E. coli
cggttggcctctagcgtatagtgat

SEQ ID NO: 224404 - DNA, 25 bp, E. coli
cggttggcctcttgcgtatagtgat

SEQ ID NO: 224405 - DNA, 25 bp, E. coli
caatggatttaccaacgagctggca

SEQ ID NO: 224406 - DNA, 25 bp, E. coli
caatggatttacgaacgagctggca

SEQ ID NO: 224407 - DNA, 25 bp, E. coli
ctattgtctgaaccccagtccggcg

SEQ ID NO: 224408 - DNA, 25 bp, E. coli
ctattgtctgaagcccagtccggcg

SEQ ID NO: 224409 - DNA, 25 bp, E. coli
aaaaatcaggaaccccgagagatcg

SEQ ID NO: 224410 - DNA, 25 bp, E. coli
aaaaatcaggaagcccgagagatcg

SEQ ID NO: 224411 - DNA, 25 bp, E. coli
tttactgccgagcatcaactgaggg

SEQ ID NO: 224412 - DNA, 25 bp, E. coli
tttactgccgaggatcaactgaggg

SEQ ID NO: 224413 - DNA, 25 bp, E. coli
tcctgagagccgaaaatgccatgtt

SEQ ID NO: 224414 - DNA, 25 bp, E. coli
tcctgagagccgtaaatgccatgtt

SEQ ID NO: 224415 - DNA, 25 bp, E. coli
tcatgaaggcagcaggaatcagccg

SEQ ID NO: 224416 - DNA, 25 bp, E. coli
tcatgaaggcaggaggaatcagccg

SEQ ID NO: 224417 - DNA, 25 bp, E. coli
gaagctatagatggtctgagtcgcc

SEQ ID NO: 224418 - DNA, 25 bp, E. coli
gaagctatagatcgtctgagtcgcc

SEQ ID NO: 224419 - DNA, 25 bp, E. coli
gaaagatacgctgaaccgaaaaggg

SEQ ID NO: 224420 - DNA, 25 bp, E. coli
gaacatagtgcatgggtcgaactga

SEQ ID NO: 224421 - DNA, 25 bp, E. coli
gaaagatacgctcaaccgaaaaggg

SEQ ID NO: 224422 - DNA, 25 bp, E. coli
gaacatagtgcaagggtcgaactga

SEQ ID NO: 224423 - DNA, 25 bp, E. coli
gggcaacacgctgatcgagcactta

SEQ ID NO: 224424 - DNA, 25 bp, E. coli
gggcaacacgctcatcgagcactta

SEQ ID NO: 224425 - DNA, 25 bp, E. coli
tggcacggcaggtttacgaaacacg

SEQ ID NO: 224426 - DNA, 25 bp, E. coli
tggcacggcaggattacgaaacacg

SEQ ID NO: 224427 - DNA, 25 bp, E. coli
caacaaaagtgttgcggtacgccgg

SEQ ID NO: 224428 - DNA, 25 bp, E. coli
caacaaaagtgtagcggtacgccgg

SEQ ID NO: 224429 - DNA, 25 bp, E. coli
tacgccggaaaaacgacacggagcg

SEQ ID NO: 224430 - DNA, 25 bp, E. coli
tacgccggaaaatcgacacggagcg

SEQ ID NO: 224431 - DNA, 25 bp, E. coli
tatcgtcctcggtttgatcgtagcc

SEQ ID NO: 224432 - DNA, 25 bp, E. coli
tatcgtcctcggattgatcgtagcc

SEQ ID NO: 224433 - DNA, 25 bp, E. coli
ttcagctcctgctaaatcgcaaggt

SEQ ID NO: 224434 - DNA, 25 bp, E. coli
tttaatgaatatcgcgtaatgacgc

SEQ ID NO: 224435 - DNA, 25 bp, E. coli
ttcagctcctgcaaaatcgcaaggt

SEQ ID NO: 224436 - DNA, 25 bp, E. coli
tttaatgaatatggcgtaatgacgc

SEQ ID NO: 224437 - DNA, 25 bp, E. coli
tcgtagccgtggctttgactgccgc

SEQ ID NO: 224438 - DNA, 25 bp, E. coli
tcgtagccgtgggtttgactgccgc

SEQ ID NO: 224439 - DNA, 25 bp, E. coli
gctgcactgatttcctctcgaggga

SEQ ID NO: 224440 - DNA, 25 bp, E. coli
gctgcactgattacctctcgaggga

SEQ ID NO: 224441 - DNA, 25 bp, E. coli
gaaaacttgatgtgcaccgacctta

SEQ ID NO: 224442 - DNA, 25 bp, E. coli
gaaaacttgatgagcaccgacctta

SEQ ID NO: 224443 - DNA, 25 bp, E. coli
gattgctgtcatcctttcgccactt

SEQ ID NO: 224444 - DNA, 25 bp, E. coli
gattgctgtcatgctttcgccactt

SEQ ID NO: 224445 - DNA, 25 bp, E. coli
ggtcaatggccactacgcaaatagt

SEQ ID NO: 224446 - DNA, 25 bp, E. coli
ggaattttggccgatcttgacgaaa

SEQ ID NO: 224447 - DNA, 25 bp, E. coli
ggaattttggcccatcttgacgaaa

SEQ ID NO: 224448 - DNA, 25 bp, E. coli
ggtcaatggccagtacgcaaatagt

SEQ ID NO: 224449 - DNA, 25 bp, E. coli
caaatctaaccagcacggagcgttg

SEQ ID NO: 224450 - DNA, 25 bp, E. coli
caaatctaaccaccacggagcgttg

SEQ ID NO: 224451 - DNA, 25 bp, E. coli
tatgtcaatcaacgtaacagcgcgt

SEQ ID NO: 224452 - DNA, 25 bp, E. coli
tatgtcaatcaaggtaacagcgcgt

SEQ ID NO: 224453 - DNA, 25 bp, E. coli
tgtacccgcagactatttgccccgt

SEQ ID NO: 224454 - DNA, 25 bp, E. coli
tgtacccgcagagtatttgccccgt

SEQ ID NO: 224455 - DNA, 25 bp, E. coli
tgaaaatcaagatcgtgtacccgca

SEQ ID NO: 224456 - DNA, 25 bp, E. coli
tgaaaatcaagaacgtgtacccgca

SEQ ID NO: 224457 - DNA, 25 bp, E. coli
tgaagaaagttacctgcgtgagctg

SEQ ID NO: 224458 - DNA, 25 bp, E. coli
tgaagaaagttagctgcgtgagctg

SEQ ID NO: 224459 - DNA, 25 bp, E. coli
tccgacgcgccaatagcagaagtgc

SEQ ID NO: 224460 - DNA, 25 bp, E. coli
tccgacgcgccattagcagaagtgc

SEQ ID NO: 224461 - DNA, 25 bp, E. coli
tctttgagaattccgaatcgcgacg

SEQ ID NO: 224462 - DNA, 25 bp, E. coli
tctttgagaattgcgaatcgcgacg

SEQ ID NO: 224463 - DNA, 25 bp, E. coli
gaaaaactgcttcagtccgacgcgc

SEQ ID NO: 224464 - DNA, 25 bp, E. coli
gaaaaactgcttgagtccgacgcgc

SEQ ID NO: 224465 - DNA, 25 bp, E. coli
ggttagtgattcttgcccggactgt

SEQ ID NO: 224466 - DNA, 25 bp, E. coli
ggttagtgattcatgcccggactgt

SEQ ID NO: 224467 - DNA, 25 bp, E. coli
ggactgttttacgacgcagcgagaa

SEQ ID NO: 224468 - DNA, 25 bp, E. coli
ggactgttttaccacgcagcgagaa

SEQ ID NO: 224469 - DNA, 25 bp, E. coli
taacagcgcgttagattgccctggt

SEQ ID NO: 224470 - DNA, 25 bp, E. coli
taacagcgcgtttgattgccctggt

SEQ ID NO: 224471 - DNA, 25 bp, E. coli
caggcgattggctgtgatgcgattt

SEQ ID NO: 224472 - DNA, 25 bp, E. coli
caggcgattggcagtgatgcgattt

SEQ ID NO: 224473 - DNA, 25 bp, E. coli
attttctgccagatattcataccag

SEQ ID NO: 224474 - DNA, 25 bp, E. coli
atcgagacaggcgattggctgtgat

SEQ ID NO: 224475 - DNA, 25 bp, E. coli
atcgagacaggccattggctgtgat

SEQ ID NO: 224476 - DNA, 25 bp, E. coli
attttctgccagttattcataccag

SEQ ID NO: 224477 - DNA, 25 bp, E. coli
tatgcacagcagttgtggattcagg

SEQ ID NO: 224478 - DNA, 25 bp, E. coli
tatgcacagcagatgtggattcagg

SEQ ID NO: 224479 - DNA, 25 bp, E. coli
tgattgatgctgttttgagcagata

SEQ ID NO: 224480 - DNA, 25 bp, E. coli
tgtggccacatacattgttcgccga

SEQ ID NO: 224481 - DNA, 25 bp, E. coli
tgtggccacatagattgttcgccga

SEQ ID NO: 224482 - DNA, 25 bp, E. coli
tgattgatgctgatttgagcagata

SEQ ID NO: 224483 - DNA, 25 bp, E. coli
tgagcagatatgcacagcagttgtg

SEQ ID NO: 224484 - DNA, 25 bp, E. coli
tgatttgagcagatatgcacagcag

SEQ ID NO: 224485 - DNA, 25 bp, E. coli
tgatttgagcagttatgcacagcag

SEQ ID NO: 224486 - DNA, 25 bp, E. coli
tgagcagatatggacagcagttgtg

SEQ ID NO: 224487 - DNA, 25 bp, E. coli
tgccagatattcataccagattgat

SEQ ID NO: 224488 - DNA, 25 bp, E. coli
tgccagatattcttaccagattgat

SEQ ID NO: 224489 - DNA, 25 bp, E. coli
gccacatacattcttcgccgatggg

SEQ ID NO: 224490 - DNA, 25 bp, E. coli
gccacatacattgttcgccgatggg

SEQ ID NO: 224491 - DNA, 25 bp, E. coli
ggctgtgatgcgtttttgccgctaa

SEQ ID NO: 224492 - DNA, 25 bp, E. coli
ggctgtgatgcgattttgccgctaa

SEQ ID NO: 224493 - DNA, 25 bp, E. coli
caacgagtcaccatgtcaatgcagg

SEQ ID NO: 224494 - DNA, 25 bp, E. coli
caacgagtcaccttgtcaatgcagg

SEQ ID NO: 224495 - DNA, 25 bp, E. coli
acatttggtgatccagttccccgcg

SEQ ID NO: 224496 - DNA, 25 bp, E. coli
acatttggtgatgcagttccccgcg

SEQ ID NO: 224497 - DNA, 25 bp, E. coli
tatgaaaacgttcctcaggcagcgg

SEQ ID NO: 224498 - DNA, 25 bp, E. coli
tatgaaaacgttgctcaggcagcgg

SEQ ID NO: 224499 - DNA, 25 bp, E. coli
tttacgccggatattaaagctgcgc

SEQ ID NO: 224500 - DNA, 25 bp, E. coli
tttacgccggattttaaagctgcgc

SEQ ID NO: 224501 - DNA, 25 bp, E. coli
ttcaccggtgtgcaatctggcccat

SEQ ID NO: 224502 - DNA, 25 bp, E. coli
ttcaccggtgtggaatctggcccat

SEQ ID NO: 224503 - DNA, 25 bp, E. coli
tcttgtactcaattgctggcctggt

SEQ ID NO: 224504 - DNA, 25 bp, E. coli
tcttgtactcaaatgctggcctggt

SEQ ID NO: 224505 - DNA, 25 bp, E. coli
gcctggctggatgctgaaatgtaaa

SEQ ID NO: 224506 - DNA, 25 bp, E. coli
gcctggctggatcctgaaatgtaaa

SEQ ID NO: 224507 - DNA, 25 bp, E. coli
gctttgctgcatcgcgaaaaaacgg

SEQ ID NO: 224508 - DNA, 25 bp, E. coli
gcttcacctgggtgcatattcaaga

SEQ ID NO: 224509 - DNA, 25 bp, E. coli
gcttcacctgggagcatattcaaga

SEQ ID NO: 224510 - DNA, 25 bp, E. coli
gctttgctgcatggcgaaaaaacgg

SEQ ID NO: 224511 - DNA, 25 bp, E. coli
gaaaacacctgttaagccatcggca

SEQ ID NO: 224512 - DNA, 25 bp, E. coli
gaaaacacctgtaaagccatcggca

SEQ ID NO: 224513 - DNA, 25 bp, E. coli
taatggaaaagctgatccgcgaagc

SEQ ID NO: 224514 - DNA, 25 bp, E. coli
taatggaaaagcagatccgcgaagc

SEQ ID NO: 224515 - DNA, 25 bp, E. coli
cactgaaggttatgacgtggtaccg

SEQ ID NO: 224516 - DNA, 25 bp, E. coli
cactgaaggttaagacgtggtaccg

SEQ ID NO: 224517 - DNA, 25 bp, E. coli
catggcagatgctccggaaatcgac

SEQ ID NO: 224518 - DNA, 25 bp, E. coli
catggcagatgcaccggaaatcgac

SEQ ID NO: 224519 - DNA, 25 bp, E. coli
aactggcgcgcatcaaacagtggcg

SEQ ID NO: 224520 - DNA, 25 bp, E. coli
aactggcgcgcaacaaacagtggcg

SEQ ID NO: 224521 - DNA, 25 bp, E. coli
tatctggacattccgttgcagcacg

SEQ ID NO: 224522 - DNA, 25 bp, E. coli
tatccgcatgtggacgacgtcatcc

SEQ ID NO: 224523 - DNA, 25 bp, E. coli
tatctggacattgcgttgcagcacg

SEQ ID NO: 224524 - DNA, 25 bp, E. coli
tatccgcatgtgcacgacgtcatcc

SEQ ID NO: 224525 - DNA, 25 bp, E. coli
tgacagcgcggttcaagaatcactg

SEQ ID NO: 224526 - DNA, 25 bp, E. coli
tgacagcgcggtacaagaatcactg

SEQ ID NO: 224527 - DNA, 25 bp, E. coli
tctgaaggctgttatcaccgctgca

SEQ ID NO: 224528 - DNA, 25 bp, E. coli
tctgaaggctgtaatcaccgctgca

SEQ ID NO: 224529 - DNA, 25 bp, E. coli
cctgcaagagaatgtgggccgtgaa

SEQ ID NO: 224530 - DNA, 25 bp, E. coli
cctgcaagagaaagtgggccgtgaa

SEQ ID NO: 224531 - DNA, 25 bp, E. coli
gcattattccgtctatgcgcggcga

SEQ ID NO: 224532 - DNA, 25 bp, E. coli
gcaggttctggaccacgttcatcac

SEQ ID NO: 224533 - DNA, 25 bp, E. coli
gcaggttctggagcacgttcatcac

SEQ ID NO: 224534 - DNA, 25 bp, E. coli
gcattattccgtgtatgcgcggcga

SEQ ID NO: 224535 - DNA, 25 bp, E. coli
tacagcccggttgaaggtgcagacg

SEQ ID NO: 224536 - DNA, 25 bp, E. coli
tacagcccggttcaaggtgcagacg

SEQ ID NO: 224537 - DNA, 25 bp, E. coli
caatgctccgttgcgtggatgcggt

SEQ ID NO: 224538 - DNA, 25 bp, E. coli
caatgctccgttccgtggatgcggt

SEQ ID NO: 224539 - DNA, 25 bp, E. coli
cacaaaacggaagaggtgctgaaac

SEQ ID NO: 224540 - DNA, 25 bp, E. coli
cacaaaacggaacaggtgctgaaac

SEQ ID NO: 224541 - DNA, 25 bp, E. coli
cagtacttccggtcgggctgactca

SEQ ID NO: 224542 - DNA, 25 bp, E. coli
cagtacttccggacgggctgactca

SEQ ID NO: 224543 - DNA, 25 bp, E. coli
tttatatcgccggtccgatgacggg

SEQ ID NO: 224544 - DNA, 25 bp, E. coli
tttatatcgccgctccgatgacggg

SEQ ID NO: 224545 - DNA, 25 bp, E. coli
ctgagctggcactggaggagaaacc

SEQ ID NO: 224546 - DNA, 25 bp, E. coli
cggtttacatgcagaaaggctggca

SEQ ID NO: 224547 - DNA, 25 bp, E. coli
cgggccatgcggtgatttttcagga

SEQ ID NO: 224548 - DNA, 25 bp, E. coli
cgggccatgcggagatttttcagga

SEQ ID NO: 224549 - DNA, 25 bp, E. coli
cggtttacatgctgaaaggctggca

SEQ ID NO: 224550 - DNA, 25 bp, E. coli
ctgagctggcacaggaggagaaacc

SEQ ID NO: 224551 - DNA, 25 bp, E. coli
gatatgaaaattataaccgcgaggc

SEQ ID NO: 224552 - DNA, 25 bp, E. coli
gatatgaaaattttaaccgcgaggc

SEQ ID NO: 224553 - DNA, 25 bp, E. coli
ggctgactcagccacactacatgga

SEQ ID NO: 224554 - DNA, 25 bp, E. coli
tgctgaaacgggaagggcataccgt

SEQ ID NO: 224555 - DNA, 25 bp, E. coli
tgctgaaacgggtagggcataccgt

SEQ ID NO: 224556 - DNA, 25 bp, E. coli
ggctgactcagcgacactacatgga

SEQ ID NO: 224557 - DNA, 25 bp, E. coli
taaccgcgaggcttttcacaaaacg

SEQ ID NO: 224558 - DNA, 25 bp, E. coli
taaccgcgaggcatttcacaaaacg

SEQ ID NO: 224559 - DNA, 25 bp, E. coli
cacagtggtatccagttgatcaaaa

SEQ ID NO: 224560 - DNA, 25 bp, E. coli
cacagtggtatcgagttgatcaaaa

SEQ ID NO: 224561 - DNA, 25 bp, E. coli
taaaattgcttgtagcaggtgcgaa

SEQ ID NO: 224562 - DNA, 25 bp, E. coli
taaaattgcttgaagcaggtgcgaa

SEQ ID NO: 224563 - DNA, 25 bp, E. coli
ttaagcaggaaaacagtcgaaactc

SEQ ID NO: 224564 - DNA, 25 bp, E. coli
ttaagcaggaaatcagtcgaaactc

SEQ ID NO: 224565 - DNA, 25 bp, E. coli
tgatcaaaacagctttacgtatggg

SEQ ID NO: 224566 - DNA, 25 bp, E. coli
tgatcaaaacaggtttacgtatggg

SEQ ID NO: 224567 - DNA, 25 bp, E. coli
gctaatttcttgcagttaagcagga

SEQ ID NO: 224568 - DNA, 25 bp, E. coli
gctaatttcttggagttaagcagga

SEQ ID NO: 224569 - DNA, 25 bp, E. coli
gaagaaattagaagttcacagtggt

SEQ ID NO: 224570 - DNA, 25 bp, E. coli
gaagaaattagatgttcacagtggt

SEQ ID NO: 224571 - DNA, 25 bp, E. coli
gaaactcatagagtcaatatcatga

SEQ ID NO: 224572 - DNA, 25 bp, E. coli
gaaatattacaagtcatagctgatg

SEQ ID NO: 224573 - DNA, 25 bp, E. coli
gaaatattacaactcatagctgatg

SEQ ID NO: 224574 - DNA, 25 bp, E. coli
gaaactcatagactcaatatcatga

SEQ ID NO: 224575 - DNA, 25 bp, E. coli
gcgaaaggatgcgtatggaaaacca

SEQ ID NO: 224576 - DNA, 25 bp, E. coli
gcgaaaggatgcctatggaaaacca

SEQ ID NO: 224577 - DNA, 25 bp, E. coli
gtatggaaaaccagtcacccggcga

SEQ ID NO: 224578 - DNA, 25 bp, E. coli
gataatcaacttacaaatcgtgagt

SEQ ID NO: 224579 - DNA, 25 bp, E. coli
gtatggaaaacctgtcacccggcga

SEQ ID NO: 224580 - DNA, 25 bp, E. coli
gataatcaactttcaaatcgtgagt

SEQ ID NO: 224581 - DNA, 25 bp, E. coli
catcgggcataacaccggcagtgag

SEQ ID NO: 224582 - DNA, 25 bp, E. coli
catcgggcataagaccggcagtgag

SEQ ID NO: 224583 - DNA, 25 bp, E. coli
ccaggtgttgctgcctgatgacaac

SEQ ID NO: 224584 - DNA, 25 bp, E. coli
gcctgggcagtgactggcacgcggt

SEQ ID NO: 224585 - DNA, 25 bp, E. coli
ccaggtgttgctccctgatgacaac

SEQ ID NO: 224586 - DNA, 25 bp, E. coli
gcctgggcagtgtctggcacgcggt

SEQ ID NO: 224587 - DNA, 25 bp, E. coli
gcataacaccggcagtgagaaactg

SEQ ID NO: 224588 - DNA, 25 bp, E. coli
gcataacaccgggagtgagaaactg

SEQ ID NO: 224589 - DNA, 25 bp, E. coli
gcagtgagaaacaggtccgcacggc

SEQ ID NO: 224590 - DNA, 25 bp, E. coli
gcagtgagaaactggtccgcacggc

SEQ ID NO: 224591 - DNA, 25 bp, E. coli
cccgtagccaggagttgctgcctga

SEQ ID NO: 224592 - DNA, 25 bp, E. coli
cccgtagccaggtgttgctgcctga

SEQ ID NO: 224593 - DNA, 25 bp, E. coli
cgggtgtagggcatgggttggcaat

SEQ ID NO: 224594 - DNA, 25 bp, E. coli
cgggtgtagggcttgggttggcaat

SEQ ID NO: 224595 - DNA, 25 bp, E. coli
cgtcgtggtggtggcactattttac

SEQ ID NO: 224596 - DNA, 25 bp, E. coli
cgtcgtggtggtcgcactattttac

SEQ ID NO: 224597 - DNA, 25 bp, E. coli
gtccaaagctctcgctgtgggccgt

SEQ ID NO: 224598 - DNA, 25 bp, E. coli
gtagttcgcaggatatcgccgccac

SEQ ID NO: 224599 - DNA, 25 bp, E. coli
gtccaaagctctggctgtgggccgt

SEQ ID NO: 224600 - DNA, 25 bp, E. coli
gtagttcgcaggttatcgccgccac

SEQ ID NO: 224601 - DNA, 25 bp, E. coli
tgtgggccgtagatcgcaggatatc

SEQ ID NO: 224602 - DNA, 25 bp, E. coli
tgtgggccgtagttcgcaggatatc

SEQ ID NO: 224603 - DNA, 25 bp, E. coli
cactgaaatttaccgcgacctgcgc

SEQ ID NO: 224604 - DNA, 25 bp, E. coli
cactgaaatttagcgcgacctgcgc

SEQ ID NO: 224605 - DNA, 25 bp, E. coli
taaagtgcgcaatcagttaaccgcg

SEQ ID NO: 224606 - DNA, 25 bp, E. coli
taaagtgcgcaaacagttaaccgcg

SEQ ID NO: 224607 - DNA, 25 bp, E. coli
tacaggatggctttggctggaccaa

SEQ ID NO: 224608 - DNA, 25 bp, E. coli
tacttcaccatgataggacttgccg

SEQ ID NO: 224609 - DNA, 25 bp, E. coli
tacaggatggctatggctggaccaa

SEQ ID NO: 224610 - DNA, 25 bp, E. coli
tacttcaccatgttaggacttgccg

SEQ ID NO: 224611 - DNA, 25 bp, E. coli
tgtgacaatgttccggcgacgcgtc

SEQ ID NO: 224612 - DNA, 25 bp, E. coli
tgtgacaatgttgcggcgacgcgtc

SEQ ID NO: 224613 - DNA, 25 bp, E. coli
tgatctgcccgatagagcaaccgtg

SEQ ID NO: 224614 - DNA, 25 bp, E. coli
tgttcagcacacgtatgaccgggag

SEQ ID NO: 224615 - DNA, 25 bp, E. coli
tgttcagcacacctatgaccgggag

SEQ ID NO: 224616 - DNA, 25 bp, E. coli
tgatctgcccgaaagagcaaccgtg

SEQ ID NO: 224617 - DNA, 25 bp, E. coli
gcaaagctgccggagataacgcgat

SEQ ID NO: 224618 - DNA, 25 bp, E. coli
gcaaagctgccgcagataacgcgat

SEQ ID NO: 224619 - DNA, 25 bp, E. coli
gacggtgttgaaaacctgcaagccg

SEQ ID NO: 224620 - DNA, 25 bp, E. coli
gacttgccgaaagcggtcactggga

SEQ ID NO: 224621 - DNA, 25 bp, E. coli
gacttgccgaaaccggtcactggga

SEQ ID NO: 224622 - DNA, 25 bp, E. coli
tcactgcgcgaagatattgacggac

SEQ ID NO: 224623 - DNA, 25 bp, E. coli
tcactgcgcgaacatattgacggac

SEQ ID NO: 224624 - DNA, 25 bp, E. coli
gacggtgttgaatacctgcaagccg

SEQ ID NO: 224625 - DNA, 25 bp, E. coli
accactgtgttaacaggagggcgtg

SEQ ID NO: 224626 - DNA, 25 bp, E. coli
actgggggcgacacgagcacaagtt

SEQ ID NO: 224627 - DNA, 25 bp, E. coli
accactgtgttatcaggagggcgtg

SEQ ID NO: 224628 - DNA, 25 bp, E. coli
actgggggcgactcgagcacaagtt

SEQ ID NO: 224629 - DNA, 25 bp, E. coli
acgagtatagcacgagtggcagcat

SEQ ID NO: 224630 - DNA, 25 bp, E. coli
acgagtatagcaggagtggcagcat

SEQ ID NO: 224631 - DNA, 25 bp, E. coli
tatgacgagtatagcaggagtggca

SEQ ID NO: 224632 - DNA, 25 bp, E. coli
tatgacgagtattgcaggagtggca

SEQ ID NO: 224633 - DNA, 25 bp, E. coli
tatagcaggagtggcagcatgcaat

SEQ ID NO: 224634 - DNA, 25 bp, E. coli
tttgataccgccaacagttattctg

SEQ ID NO: 224635 - DNA, 25 bp, E. coli
tttgataccgcctacagttattctg

SEQ ID NO: 224636 - DNA, 25 bp, E. coli
tatagcaggagtcgcagcatgcaat

SEQ ID NO: 224637 - DNA, 25 bp, E. coli
ttattctgacgggagcagcgaagag

SEQ ID NO: 224638 - DNA, 25 bp, E. coli
ttattctgacggcagcagcgaagag

SEQ ID NO: 224639 - DNA, 25 bp, E. coli
gcaggagtggcaccatgcaatacaa

SEQ ID NO: 224640 - DNA, 25 bp, E. coli
gcaggagtggcagcatgcaatacaa

SEQ ID NO: 224641 - DNA, 25 bp, E. coli
gataccgccaactgttattctgacg

SEQ ID NO: 224642 - DNA, 25 bp, E. coli
gataccgccaacagttattctgacg

SEQ ID NO: 224643 - DNA, 25 bp, E. coli
gagtggcagcatccaatacaacccc

SEQ ID NO: 224644 - DNA, 25 bp, E. coli
gagtggcagcatgcaatacaacccc

SEQ ID NO: 224645 - DNA, 25 bp, E. coli
gatgctaccactctgttatcaggag

SEQ ID NO: 224646 - DNA, 25 bp, E. coli
gatgctaccactgtgttatcaggag

SEQ ID NO: 224647 - DNA, 25 bp, E. coli
tttgtcaacaatctggccgcgcata

SEQ ID NO: 224648 - DNA, 25 bp, E. coli
tttgtcaacaatgtggccgcgcata

SEQ ID NO: 224649 - DNA, 25 bp, E. coli
tgtagaccgaattaagcgttcatgc

SEQ ID NO: 224650 - DNA, 25 bp, E. coli
tgtagaccgaataaagcgttcatgc

SEQ ID NO: 224651 - DNA, 25 bp, E. coli
tggtcactggcttatacgacgcaga

SEQ ID NO: 224652 - DNA, 25 bp, E. coli
tgaagactccgacagtgaaccccgt

SEQ ID NO: 224653 - DNA, 25 bp, E. coli
tgaagactccgagagtgaaccccgt

SEQ ID NO: 224654 - DNA, 25 bp, E. coli
gaatttgcctgcatttgtagaccga

SEQ ID NO: 224655 - DNA, 25 bp, E. coli
gaatgcacacaaaaacggcgtaaag

SEQ ID NO: 224656 - DNA, 25 bp, E. coli
gaatttgcctgcttttgtagaccga

SEQ ID NO: 224657 - DNA, 25 bp, E. coli
gaatgcacacaataacggcgtaaag

SEQ ID NO: 224658 - DNA, 25 bp, E. coli
cgttagaaagggtcacacgcatgcc

SEQ ID NO: 224659 - DNA, 25 bp, E. coli
cgacgcagagttacaggattactaa

SEQ ID NO: 224660 - DNA, 25 bp, E. coli
cgacgcagagtttcaggattactaa

SEQ ID NO: 224661 - DNA, 25 bp, E. coli
cgttagaaagggacacacgcatgcc

SEQ ID NO: 224662 - DNA, 25 bp, E. coli
tggtcactggctaatacgacgcaga

SEQ ID NO: 224663 - DNA, 25 bp, E. coli
taataaaggcataaatccaccccgc

SEQ ID NO: 224664 - DNA, 25 bp, E. coli
taataaaggcattaatccaccccgc

SEQ ID NO: 224665 - DNA, 25 bp, E. coli
gacgaagcaaaatcagcacggttga

SEQ ID NO: 224666 - DNA, 25 bp, E. coli
gatgcgctacgcatgccagtgtcta

SEQ ID NO: 224667 - DNA, 25 bp, E. coli
gatgcgctacgcttgccagtgtcta

SEQ ID NO: 224668 - DNA, 25 bp, E. coli
gacgaagcaaaaacagcacggttga

SEQ ID NO: 224669 - DNA, 25 bp, E. coli
taacaaaatagccattgcaccgggt

SEQ ID NO: 224670 - DNA, 25 bp, E. coli
taacaaaatagcgattgcaccgggt

SEQ ID NO: 224671 - DNA, 25 bp, E. coli
aaaagtggctttggcgcaccttagg

SEQ ID NO: 224672 - DNA, 25 bp, E. coli
aaaagtggctttcgcgcaccttagg

SEQ ID NO: 224673 - DNA, 25 bp, E. coli
tacgccgtcttatagaaaatgatgg

SEQ ID NO: 224674 - DNA, 25 bp, E. coli
tacgccgtcttaaagaaaatgatgg

SEQ ID NO: 224675 - DNA, 25 bp, E. coli
tgcaccgggttgtacaatttacaaa

SEQ ID NO: 224676 - DNA, 25 bp, E. coli
tgaaaatgaccctcttgcaagtgca

SEQ ID NO: 224677 - DNA, 25 bp, E. coli
tgaaaatgacccacttgcaagtgca

SEQ ID NO: 224678 - DNA, 25 bp, E. coli
tgcaccgggttgaacaatttacaaa

SEQ ID NO: 224679 - DNA, 25 bp, E. coli
tcggcgatttctagaacggcataat

SEQ ID NO: 224680 - DNA, 25 bp, E. coli
tcggcgatttcttgaacggcataat

SEQ ID NO: 224681 - DNA, 25 bp, E. coli
cctgtagtacggcaagctgcttaga

SEQ ID NO: 224682 - DNA, 25 bp, E. coli
cctgtagtacgggaagctgcttaga

SEQ ID NO: 224683 - DNA, 25 bp, E. coli
gcataactttgtcgataactcagga

SEQ ID NO: 224684 - DNA, 25 bp, E. coli
gcataactttgtggataactcagga

SEQ ID NO: 224685 - DNA, 25 bp, E. coli
cttaggtcagactaggtgtccggga

SEQ ID NO: 224686 - DNA, 25 bp, E. coli
cttaggtcagacaaggtgtccggga

SEQ ID NO: 224687 - DNA, 25 bp, E. coli
taactcaggaaggaaaaagtggctt

SEQ ID NO: 224688 - DNA, 25 bp, E. coli
taagcacgagtcttcacataatctg

SEQ ID NO: 224689 - DNA, 25 bp, E. coli
taactcaggaagcaaaaagtggctt

SEQ ID NO: 224690 - DNA, 25 bp, E. coli
taagcacgagtcatcacataatctg

SEQ ID NO: 224691 - DNA, 25 bp, E. coli
caaagaatatgcgtcgctggatgac

SEQ ID NO: 224692 - DNA, 25 bp, E. coli
caaagaatatgcctcgctggatgac

SEQ ID NO: 224693 - DNA, 25 bp, E. coli
catctggcgcctctggaaatcaaaa

SEQ ID NO: 224694 - DNA, 25 bp, E. coli
catctggcgcctgtggaaatcaaaa

SEQ ID NO: 224695 - DNA, 25 bp, E. coli
taacgggtataaacaggcgctcagc

SEQ ID NO: 224696 - DNA, 25 bp, E. coli
tactcaggactaatacgacgatggc

SEQ ID NO: 224697 - DNA, 25 bp, E. coli
tactcaggactattacgacgatggc

SEQ ID NO: 224698 - DNA, 25 bp, E. coli
tatcaggctatatctggcccggagg

SEQ ID NO: 224699 - DNA, 25 bp, E. coli
tatcaggctataactggcccggagg

SEQ ID NO: 224700 - DNA, 25 bp, E. coli
tgcggcacgcagaacggtaaaatct

SEQ ID NO: 224701 - DNA, 25 bp, E. coli
tgcggcacgcagtacggtaaaatct

SEQ ID NO: 224702 - DNA, 25 bp, E. coli
tcagagctgatgtccaccggtgtgg

SEQ ID NO: 224703 - DNA, 25 bp, E. coli
tcagagctgatgaccaccggtgtgg

SEQ ID NO: 224704 - DNA, 25 bp, E. coli
gactttacccgcaagtggcaggacg

SEQ ID NO: 224705 - DNA, 25 bp, E. coli
gactttacccgctagtggcaggacg

SEQ ID NO: 224706 - DNA, 25 bp, E. coli
gatcatgcagaaggtatgcgccgcg

SEQ ID NO: 224707 - DNA, 25 bp, E. coli
gttcagtattaccacgccgacggta

SEQ ID NO: 224708 - DNA, 25 bp, E. coli
gttcagtattacgacgccgacggta

SEQ ID NO: 224709 - DNA, 25 bp, E. coli
gatcatgcagaacgtatgcgccgcg

SEQ ID NO: 224710 - DNA, 25 bp, E. coli
taacgggtataatcaggcgctcagc

SEQ ID NO: 224711 - DNA, 25 bp, E. coli
gatgtcggcccacttccggaagaag

SEQ ID NO: 224712 - DNA, 25 bp, E. coli
gatgtcggcccagttccggaagaag

SEQ ID NO: 224713 - DNA, 25 bp, E. coli
caatctgttattcatccggcaggga

SEQ ID NO: 224714 - DNA, 25 bp, E. coli
caatctgttattgatccggcaggga

SEQ ID NO: 224715 - DNA, 25 bp, E. coli
tatccgccgtgataagtcgtggcac

SEQ ID NO: 224716 - DNA, 25 bp, E. coli
tatccgccgtgaaaagtcgtggcac

SEQ ID NO: 224717 - DNA, 25 bp, E. coli
tatcacacgtaaggacggcgacagt

SEQ ID NO: 224718 - DNA, 25 bp, E. coli
tatcacacgtaacgacggcgacagt

SEQ ID NO: 224719 - DNA, 25 bp, E. coli
ttaatcgcacctatgccaaccggag

SEQ ID NO: 224720 - DNA, 25 bp, E. coli
ttaatcgcacctttgccaaccggag

SEQ ID NO: 224721 - DNA, 25 bp, E. coli
tcgggcggatctgtacacggaaatg

SEQ ID NO: 224722 - DNA, 25 bp, E. coli
tcgggcggatctctacacggaaatg

SEQ ID NO: 224723 - DNA, 25 bp, E. coli
tctcgctacaacaggcagaaggtcg

SEQ ID NO: 224724 - DNA, 25 bp, E. coli
tctcgctacaactggcagaaggtcg

SEQ ID NO: 224725 - DNA, 25 bp, E. coli
gctgcgcggcacaaactgaagatgg

SEQ ID NO: 224726 - DNA, 25 bp, E. coli
gctgcgcggcactaactgaagatgg

SEQ ID NO: 224727 - DNA, 25 bp, E. coli
gcttgatctggacctggacgacgcc

SEQ ID NO: 224728 - DNA, 25 bp, E. coli
gcttgatctggagctggacgacgcc

SEQ ID NO: 224729 - DNA, 25 bp, E. coli
taattgccagctcgttgcatacccg

SEQ ID NO: 224730 - DNA, 25 bp, E. coli
taattgccagctggttgcatacccg

SEQ ID NO: 224731 - DNA, 25 bp, E. coli
gacctgtcggataaacctgtggagc

SEQ ID NO: 224732 - DNA, 25 bp, E. coli
gacctgtcggattaacctgtggagc

SEQ ID NO: 224733 - DNA, 25 bp, E. coli
gagattgaacattctggcgcaccgg

SEQ ID NO: 224734 - DNA, 25 bp, E. coli
gagattgaacatactggcgcaccgg

SEQ ID NO: 224735 - DNA, 25 bp, E. coli
aacctataaagacgatgtgagccgc

SEQ ID NO: 224736 - DNA, 25 bp, E. coli
aacctataaagaggatgtgagccgc

SEQ ID NO: 224737 - DNA, 25 bp, E. coli
aagatttgtggaccgtttggcacca

SEQ ID NO: 224738 - DNA, 25 bp, E. coli
caccgtcaggaaggaagttatgtca

SEQ ID NO: 224739 - DNA, 25 bp, E. coli
caccgtcaggaacgaagttatgtca

SEQ ID NO: 224740 - DNA, 25 bp, E. coli
agtgaatacctgacgttacgccatc

SEQ ID NO: 224741 - DNA, 25 bp, E. coli
agtgaatacctgtcgttacgccatc

SEQ ID NO: 224742 - DNA, 25 bp, E. coli
aaactgagccggatctccatctgga

SEQ ID NO: 224743 - DNA, 25 bp, E. coli
aaactgagccggttctccatctgga

SEQ ID NO: 224744 - DNA, 25 bp, E. coli
aagatttgtggagcgtttggcacca

SEQ ID NO: 224745 - DNA, 25 bp, E. coli
tattctgacggaagatggctggctc

SEQ ID NO: 224746 - DNA, 25 bp, E. coli
tatcaatatcaagaccgtcaggaag

SEQ ID NO: 224747 - DNA, 25 bp, E. coli
tatcaatatcaacaccgtcaggaag

SEQ ID NO: 224748 - DNA, 25 bp, E. coli
tattctgacggatgatggctggctc

SEQ ID NO: 224749 - DNA, 25 bp, E. coli
tgtgagccgcagagttatcaatatc

SEQ ID NO: 224750 - DNA, 25 bp, E. coli
tgtgagccgcagtgttatcaatatc

SEQ ID NO: 224751 - DNA, 25 bp, E. coli
cctgcttgaggatatccgggaaata

SEQ ID NO: 224752 - DNA, 25 bp, E. coli
cctgcttgaggaaatccgggaaata

SEQ ID NO: 224753 - DNA, 25 bp, E. coli
gaaatagcagactgtcaggagcaag

SEQ ID NO: 224754 - DNA, 25 bp, E. coli
gaaatagcagacagtcaggagcaag

SEQ ID NO: 224755 - DNA, 25 bp, E. coli
gatgcaaagtatacagtcactgcag

SEQ ID NO: 224756 - DNA, 25 bp, E. coli
gatgcaaagtattcagtcactgcag

SEQ ID NO: 224757 - DNA, 25 bp, E. coli
cagtgaagtgatccagcgagttttg

SEQ ID NO: 224758 - DNA, 25 bp, E. coli
caggttgttgaggtagtacgccgga

SEQ ID NO: 224759 - DNA, 25 bp, E. coli
cataatttgtagagagtgccgtaac

SEQ ID NO: 224760 - DNA, 25 bp, E. coli
cataatttgtagtgagtgccgtaac

SEQ ID NO: 224761 - DNA, 25 bp, E. coli
cagtgaagtgatgcagcgagttttg

SEQ ID NO: 224762 - DNA, 25 bp, E. coli
caggttgttgagctagtacgccgga

SEQ ID NO: 224763 - DNA, 25 bp, E. coli
aaaactatcgagcgcaaaactgaag

SEQ ID NO: 224764 - DNA, 25 bp, E. coli
aaaactatcgagggcaaaactgaag

SEQ ID NO: 224765 - DNA, 25 bp, E. coli
ttacacaggagtaatgatggaatag

SEQ ID NO: 224766 - DNA, 25 bp, E. coli
ttacacaggagttatgatggaatag

SEQ ID NO: 224767 - DNA, 25 bp, E. coli
gccgtaacagtgaagtgatgcagcg

SEQ ID NO: 224768 - DNA, 25 bp, E. coli
gccgctatgacaggcaattgaacat

SEQ ID NO: 224769 - DNA, 25 bp, E. coli
gccgtaacagtgtagtgatgcagcg

SEQ ID NO: 224770 - DNA, 25 bp, E. coli
gccgctatgacacgcaattgaacat

SEQ ID NO: 224771 - DNA, 25 bp, E. coli
gcgagttttgatattttacacagga

SEQ ID NO: 224772 - DNA, 25 bp, E. coli
gcgagttttgattttttacacagga

SEQ ID NO: 224773 - DNA, 25 bp, E. coli
gacaggcaattgaacataatttgta

SEQ ID NO: 224774 - DNA, 25 bp, E. coli
gaaatacgccgctatgacaggcaat

SEQ ID NO: 224775 - DNA, 25 bp, E. coli
gacaggcaattgtacataatttgta

SEQ ID NO: 224776 - DNA, 25 bp, E. coli
gaaatacgccgcaatgacaggcaat

SEQ ID NO: 224777 - DNA, 25 bp, E. coli
tggttacgggttattcccatctgaa

SEQ ID NO: 224778 - DNA, 25 bp, E. coli
tggttacgggtttttcccatctgaa

SEQ ID NO: 224779 - DNA, 25 bp, E. coli
taaaaactgagctagagtccatcag

SEQ ID NO: 224780 - DNA, 25 bp, E. coli
taaaaactgagcaagagtccatcag

SEQ ID NO: 224781 - DNA, 25 bp, E. coli
acttcatgcccatttatgcccgatg

SEQ ID NO: 224782 - DNA, 25 bp, E. coli
acttcatgcccaattatgcccgatg

SEQ ID NO: 224783 - DNA, 25 bp, E. coli
tatataaagccctaaccaccgttgg

SEQ ID NO: 224784 - DNA, 25 bp, E. coli
tatataaagcccaaaccaccgttgg

SEQ ID NO: 224785 - DNA, 25 bp, E. coli
ttcggcatcgctcacattttatggg

SEQ ID NO: 224786 - DNA, 25 bp, E. coli
ttcggcatcgctgacattttatggg

SEQ ID NO: 224787 - DNA, 25 bp, E. coli
tgaaaggctcactactcccggaatg

SEQ ID NO: 224788 - DNA, 25 bp, E. coli
tgaaaggctcacaactcccggaatg

SEQ ID NO: 224789 - DNA, 25 bp, E. coli
tcgacgatcatttttggcataagaa

SEQ ID NO: 224790 - DNA, 25 bp, E. coli
tcgacgatcattattggcataagaa

SEQ ID NO: 224791 - DNA, 25 bp, E. coli
ccaccgttggaattagaaatagttg

SEQ ID NO: 224792 - DNA, 25 bp, E. coli
cctattcagagctacttattcaggg

SEQ ID NO: 224793 - DNA, 25 bp, E. coli
cctattcagagcaacttattcaggg

SEQ ID NO: 224794 - DNA, 25 bp, E. coli
ccaccgttggaaatagaaatagttg

SEQ ID NO: 224795 - DNA, 25 bp, E. coli
ggaatgcggattttctttgccctga

SEQ ID NO: 224796 - DNA, 25 bp, E. coli
ggaatgcggattatctttgccctga

SEQ ID NO: 224797 - DNA, 25 bp, E. coli
taattggctagctacataccacccc

SEQ ID NO: 224798 - DNA, 25 bp, E. coli
taattggctagcaacataccacccc

SEQ ID NO: 224799 - DNA, 25 bp, E. coli
taatcacgtatcaagtaatagtcgg

SEQ ID NO: 224800 - DNA, 25 bp, E. coli
taatcacgtatctagtaatagtcgg

SEQ ID NO: 224801 - DNA, 25 bp, E. coli
aatggtagcgtctgtggacgccact

SEQ ID NO: 224802 - DNA, 25 bp, E. coli
aatggtagcgtcagtggacgccact

SEQ ID NO: 224803 - DNA, 25 bp, E. coli
catgccgctgaagaaagtcgtgcag

SEQ ID NO: 224804 - DNA, 25 bp, E. coli
catgccgctgaacaaagtcgtgcag

SEQ ID NO: 224805 - DNA, 25 bp, E. coli
taaaggcacgattgcggaacagatc

SEQ ID NO: 224806 - DNA, 25 bp, E. coli
taaaggcacgatagcggaacagatc

SEQ ID NO: 224807 - DNA, 25 bp, E. coli
cgggtacggtagcaggtttctcgct

SEQ ID NO: 224808 - DNA, 25 bp, E. coli
aggcggtagccgcatcatcactaca

SEQ ID NO: 224809 - DNA, 25 bp, E. coli
aggcggtagccggatcatcactaca

SEQ ID NO: 224810 - DNA, 25 bp, E. coli
cgggtacggtaggaggtttctcgct

SEQ ID NO: 224811 - DNA, 25 bp, E. coli
tgtggacgccactgccactcaggtg

SEQ ID NO: 224812 - DNA, 25 bp, E. coli
tgtggacgccacagccactcaggtg

SEQ ID NO: 224813 - DNA, 25 bp, E. coli
gctgaacaaagtcgtgcagcccgcg

SEQ ID NO: 224814 - DNA, 25 bp, E. coli
gctgaacaaagtggtgcagcccgcg

SEQ ID NO: 224815 - DNA, 25 bp, E. coli
cgcgaaacagggaatggtagcgtct

SEQ ID NO: 224816 - DNA, 25 bp, E. coli
cgcgaaacagggtatggtagcgtct

SEQ ID NO: 224817 - DNA, 25 bp, E. coli
ctgcgccgcccgtctcgtatggtgt

SEQ ID NO: 224818 - DNA, 25 bp, E. coli
ctgcgccgcccgactcgtatggtgt

SEQ ID NO: 224819 - DNA, 25 bp, E. coli
ggaagttgttttagcgccgccgccg

SEQ ID NO: 224820 - DNA, 25 bp, E. coli
ggcaccatgccggtgaacaaagtcg

SEQ ID NO: 224821 - DNA, 25 bp, E. coli
ggaagttgtttttgcgccgccgccg

SEQ ID NO: 224822 - DNA, 25 bp, E. coli
ggcaccatgccgctgaacaaagtcg

SEQ ID NO: 224823 - DNA, 25 bp, E. coli
aatattgatgttatcccgtgtcgcc

SEQ ID NO: 224824 - DNA, 25 bp, E. coli
aatattgatgttttcccgtgtcgcc

SEQ ID NO: 224825 - DNA, 25 bp, E. coli
tatgatattgcacaagctcttcggc

SEQ ID NO: 224826 - DNA, 25 bp, E. coli
tatgatgagctataagacaaggccg

SEQ ID NO: 224827 - DNA, 25 bp, E. coli
tatgatattgcagaagctcttcggc

SEQ ID NO: 224828 - DNA, 25 bp, E. coli
tatgatgagctaaaagacaaggccg

SEQ ID NO: 224829 - DNA, 25 bp, E. coli
tatattgacggctaaagcagacgtc

SEQ ID NO: 224830 - DNA, 25 bp, E. coli
tatattgacggcaaaagcagacgtc

SEQ ID NO: 224831 - DNA, 25 bp, E. coli
ttttgcgtaaaattaaggatgccgg

SEQ ID NO: 224832 - DNA, 25 bp, E. coli
ttttgcgtaaaaataaggatgccgg

SEQ ID NO: 224833 - DNA, 25 bp, E. coli
gcagacgtcactcatcaggaagcag

SEQ ID NO: 224834 - DNA, 25 bp, E. coli
gcagacgtcactgatcaggaagcag

SEQ ID NO: 224835 - DNA, 25 bp, E. coli
ccaggttgccagtcgtttgttagag

SEQ ID NO: 224836 - DNA, 25 bp, E. coli
ccaggttgccagacgtttgttagag

SEQ ID NO: 224837 - DNA, 25 bp, E. coli
cattgtgaccaagttgcaagagagg

SEQ ID NO: 224838 - DNA, 25 bp, E. coli
cattgtgaccaacttgcaagagagg

SEQ ID NO: 224839 - DNA, 25 bp, E. coli
gatcatactcaccagcaattgcaag

SEQ ID NO: 224840 - DNA, 25 bp, E. coli
gatcatactcacgagcaattgcaag

SEQ ID NO: 224841 - DNA, 25 bp, E. coli
ggatgccggagaagccttaaacaat

SEQ ID NO: 224842 - DNA, 25 bp, E. coli
ggatgccggagatgccttaaacaat

SEQ ID NO: 224843 - DNA, 25 bp, E. coli
gatgaacaacgctatacactgacgg

SEQ ID NO: 224844 - DNA, 25 bp, E. coli
gatgaacaacgcaatacactgacgg

SEQ ID NO: 224845 - DNA, 25 bp, E. coli
cagcaacggctacattaggacgcac

SEQ ID NO: 224846 - DNA, 25 bp, E. coli
cagcaacggctagattaggacgcac

SEQ ID NO: 224847 - DNA, 25 bp, E. coli
tactttgacatgatgcaggaggaac

SEQ ID NO: 224848 - DNA, 25 bp, E. coli
tactttgacatgttgcaggaggaac

SEQ ID NO: 224849 - DNA, 25 bp, E. coli
actttgcagcgtggtggaggcatcc

SEQ ID NO: 224850 - DNA, 25 bp, E. coli
actttgcagcgtcgtggaggcatcc

SEQ ID NO: 224851 - DNA, 25 bp, E. coli
tatgacaatgtcagcgcacctatca

SEQ ID NO: 224852 - DNA, 25 bp, E. coli
tatgacaatgtctgcgcacctatca

SEQ ID NO: 224853 - DNA, 25 bp, E. coli
tatagacacgaaaaccgcgcagaag

SEQ ID NO: 224854 - DNA, 25 bp, E. coli
tatagacacgaataccgcgcagaag

SEQ ID NO: 224855 - DNA, 25 bp, E. coli
gcacctatcaatccagtggcaacgg

SEQ ID NO: 224856 - DNA, 25 bp, E. coli
gcacctatcaatgcagtggcaacgg

SEQ ID NO: 224857 - DNA, 25 bp, E. coli
ggtgcgcagctctaacgggtagtta

SEQ ID NO: 224858 - DNA, 25 bp, E. coli
ggacgcaccggtttcatagctatac

SEQ ID NO: 224859 - DNA, 25 bp, E. coli
ggtgcgcagctcaaacgggtagtta

SEQ ID NO: 224860 - DNA, 25 bp, E. coli
tggaatgccgcaaaagcatctgcct

SEQ ID NO: 224861 - DNA, 25 bp, E. coli
tggcactgtgcaaacggctctcgaa

SEQ ID NO: 224862 - DNA, 25 bp, E. coli
tggcactgtgcatacggctctcgaa

SEQ ID NO: 224863 - DNA, 25 bp, E. coli
tggaatgccgcataagcatctgcct

SEQ ID NO: 224864 - DNA, 25 bp, E. coli
ggacgcaccggtatcatagctatac

SEQ ID NO: 224865 - DNA, 25 bp, E. coli
gagcaaaactcattgcagcaacggc

SEQ ID NO: 224866 - DNA, 25 bp, E. coli
gagcaaaactcaatgcagcaacggc

SEQ ID NO: 224867 - DNA, 25 bp, E. coli
aacgatatccgcgtgatgcgtgaac

SEQ ID NO: 224868 - DNA, 25 bp, E. coli
ccatcagccagataaccgaattttg

SEQ ID NO: 224869 - DNA, 25 bp, E. coli
ccatcagccagaaaaccgaattttg

SEQ ID NO: 224870 - DNA, 25 bp, E. coli
caggacaacttcaggtccggtaacg

SEQ ID NO: 224871 - DNA, 25 bp, E. coli
caggacaacttctggtccggtaacg

SEQ ID NO: 224872 - DNA, 25 bp, E. coli
aacgatatccgcctgatgcgtgaac

SEQ ID NO: 224873 - DNA, 25 bp, E. coli
acaacttctggtccggtaacgtgct

SEQ ID NO: 224874 - DNA, 25 bp, E. coli
acaacttctggtgcggtaacgtgct

SEQ ID NO: 224875 - DNA, 25 bp, E. coli
tatccgcctgatgcgtgaacgtgac

SEQ ID NO: 224876 - DNA, 25 bp, E. coli
tatccgcctgatccgtgaacgtgac

SEQ ID NO: 224877 - DNA, 25 bp, E. coli
tgtttgacatggagaagaccatcgc

SEQ ID NO: 224878 - DNA, 25 bp, E. coli
tgtttgacatggtgaagaccatcgc

SEQ ID NO: 224879 - DNA, 25 bp, E. coli
tgcgtgaacgtgtcggacgtaacca

SEQ ID NO: 224880 - DNA, 25 bp, E. coli
tgcgtgaacgtgacggacgtaacca

SEQ ID NO: 224881 - DNA, 25 bp, E. coli
tgccaggacaacttctggtccggta

SEQ ID NO: 224882 - DNA, 25 bp, E. coli
tgccaggacaacatctggtccggta

SEQ ID NO: 224883 - DNA, 25 bp, E. coli
cctgatgcgtgatcgtgacggacgt

SEQ ID NO: 224884 - DNA, 25 bp, E. coli
cctgatgcgtgaacgtgacggacgt

SEQ ID NO: 224885 - DNA, 25 bp, E. coli
gggtgggctaaccatatccgcctga

SEQ ID NO: 224886 - DNA, 25 bp, E. coli
gggtgggctaacgatatccgcctga

SEQ ID NO: 224887 - DNA, 25 bp, E. coli
ggctaacgatatccgcctgatgcgt

SEQ ID NO: 224888 - DNA, 25 bp, E. coli
ggctaacgatatgcgcctgatgcgt

SEQ ID NO: 224889 - DNA, 25 bp, E. coli
cattttttcctgttggcccagccga

SEQ ID NO: 224890 - DNA, 25 bp, E. coli
cattttttcctgatggcccagccga

SEQ ID NO: 224891 - DNA, 25 bp, E. coli
cagttactgctaagtgcgctcgcca

SEQ ID NO: 224892 - DNA, 25 bp, E. coli
cagttactgctatgtgcgctcgcca

SEQ ID NO: 224893 - DNA, 25 bp, E. coli
tacgttgaaaacgaagagatccgcg

SEQ ID NO: 224894 - DNA, 25 bp, E. coli
tacgttgaaaaccaagagatccgcg

SEQ ID NO: 224895 - DNA, 25 bp, E. coli
tatatggctgtactggcaacccgtc

SEQ ID NO: 224896 - DNA, 25 bp, E. coli
tatatggctgtagtggcaacccgtc

SEQ ID NO: 224897 - DNA, 25 bp, E. coli
tgtttttcagctgggcggcattgcc

SEQ ID NO: 224898 - DNA, 25 bp, E. coli
tgttatttacgcatccctggcatgg

SEQ ID NO: 224899 - DNA, 25 bp, E. coli
tgttatttacgcttccctggcatgg

SEQ ID NO: 224900 - DNA, 25 bp, E. coli
tgtttttcagctcggcggcattgcc

SEQ ID NO: 224901 - DNA, 25 bp, E. coli
tgaagtcaccgatagtaatgctctg

SEQ ID NO: 224902 - DNA, 25 bp, E. coli
tgaatacagaatggcaccaggagcg

SEQ ID NO: 224903 - DNA, 25 bp, E. coli
tgaagtcaccgaaagtaatgctctg

SEQ ID NO: 224904 - DNA, 25 bp, E. coli
tgaatacagaatcgcaccaggagcg

SEQ ID NO: 224905 - DNA, 25 bp, E. coli
gccacctggcgccaatgaagaaaat

SEQ ID NO: 224906 - DNA, 25 bp, E. coli
gccacctggcgcgaatgaagaaaat

SEQ ID NO: 224907 - DNA, 25 bp, E. coli
gaatcatatctacctgctgctggga

SEQ ID NO: 224908 - DNA, 25 bp, E. coli
gaatcatatctagctgctgctggga

SEQ ID NO: 224909 - DNA, 25 bp, E. coli
tcagctttcgggtaacgatctcgcg

SEQ ID NO: 224910 - DNA, 25 bp, E. coli
tcagctttcgggaaacgatctcgcg

SEQ ID NO: 224911 - DNA, 25 bp, E. coli
cagaccgagccgaatagctgttgtg

SEQ ID NO: 224912 - DNA, 25 bp, E. coli
cagaccgagccgtatagctgttgtg

SEQ ID NO: 224913 - DNA, 25 bp, E. coli
atatttgcacaatacggtcccctcg

SEQ ID NO: 224914 - DNA, 25 bp, E. coli
atatttgcacaaaacggtcccctcg

SEQ ID NO: 224915 - DNA, 25 bp, E. coli
ttcggcaaggtcagaaccgtcccag

SEQ ID NO: 224916 - DNA, 25 bp, E. coli
ttcggcaaggtctgaaccgtcccag

SEQ ID NO: 224917 - DNA, 25 bp, E. coli
tatagctactcacagccaggttgat

SEQ ID NO: 224918 - DNA, 25 bp, E. coli
tatagctactcagagccaggttgat

SEQ ID NO: 224919 - DNA, 25 bp, E. coli
tgctggagaataatcggcaaggtct

SEQ ID NO: 224920 - DNA, 25 bp, E. coli
tgctggagaatattcggcaaggtct

SEQ ID NO: 224921 - DNA, 25 bp, E. coli
ccggtcggacctggcaactatagct

SEQ ID NO: 224922 - DNA, 25 bp, E. coli
ccggtcggacctcgcaactatagct

SEQ ID NO: 224923 - DNA, 25 bp, E. coli
gctgtatgagccagtttgttgctgg

SEQ ID NO: 224924 - DNA, 25 bp, E. coli
gctgtatgagcctgtttgttgctgg

SEQ ID NO: 224925 - DNA, 25 bp, E. coli
cgtcccagccatcgccatgaaaggg

SEQ ID NO: 224926 - DNA, 25 bp, E. coli
ctgttgtggtgaaaacatggagacg

SEQ ID NO: 224927 - DNA, 25 bp, E. coli
ctgttgtggtgataacatggagacg

SEQ ID NO: 224928 - DNA, 25 bp, E. coli
cgtcccagccatggccatgaaaggg

SEQ ID NO: 224929 - DNA, 25 bp, E. coli
gtttactaaaacgacgaatcgcctg

SEQ ID NO: 224930 - DNA, 25 bp, E. coli
gtttactaaaaccacgaatcgcctg

SEQ ID NO: 224931 - DNA, 25 bp, E. coli
gattttcaggcagaacaagcatcaa

SEQ ID NO: 224932 - DNA, 25 bp, E. coli
gattttcaggcacaacaagcatcaa

SEQ ID NO: 224933 - DNA, 25 bp, E. coli
taaaagagcttcctgatgcggtggc

SEQ ID NO: 224934 - DNA, 25 bp, E. coli
taaaagagcttcgtgatgcggtggc

SEQ ID NO: 224935 - DNA, 25 bp, E. coli
aaatggtgcctgactcctgcgggtt

SEQ ID NO: 224936 - DNA, 25 bp, E. coli
aaatggtgcctgtctcctgcgggtt

SEQ ID NO: 224937 - DNA, 25 bp, E. coli
tatcgcttgataaacttggcctgga

SEQ ID NO: 224938 - DNA, 25 bp, E. coli
tatcgcttgatatacttggcctgga

SEQ ID NO: 224939 - DNA, 25 bp, E. coli
tatctggcaacaaaaccggaaggtg

SEQ ID NO: 224940 - DNA, 25 bp, E. coli
tatctggcaacataaccggaaggtg

SEQ ID NO: 224941 - DNA, 25 bp, E. coli
tataaaaatcgtccaggctgggcgc

SEQ ID NO: 224942 - DNA, 25 bp, E. coli
tataaaaatcgtgcaggctgggcgc

SEQ ID NO: 224943 - DNA, 25 bp, E. coli
tcaaacttaagtgacggccggatgc

SEQ ID NO: 224944 - DNA, 25 bp, E. coli
tcaaacttaagtcacggccggatgc

SEQ ID NO: 224945 - DNA, 25 bp, E. coli
gctgggcgcatgtccgtttaaaacg

SEQ ID NO: 224946 - DNA, 25 bp, E. coli
gctgggcgcatgaccgtttaaaacg

SEQ ID NO: 224947 - DNA, 25 bp, E. coli
gaagaacttgcatagagcagcccgg

SEQ ID NO: 224948 - DNA, 25 bp, E. coli
gaattacaggcattttacggcgcac

SEQ ID NO: 224949 - DNA, 25 bp, E. coli
gaattacaggcaatttacggcgcac

SEQ ID NO: 224950 - DNA, 25 bp, E. coli
gaagaacttgcaaagagcagcccgg

SEQ ID NO: 224951 - DNA, 25 bp, E. coli
gaacgcctggtggacttaatgatcg

SEQ ID NO: 224952 - DNA, 25 bp, E. coli
gaacgcctggtgcacttaatgatcg

SEQ ID NO: 224953 - DNA, 25 bp, E. coli
tggatttacttctcaggcgcgtgac

SEQ ID NO: 224954 - DNA, 25 bp, E. coli
tggatttacttcacaggcgcgtgac

SEQ ID NO: 224955 - DNA, 25 bp, E. coli
aatggtcagcgccttgatgatcccg

SEQ ID NO: 224956 - DNA, 25 bp, E. coli
aatggtcagcgcgttgatgatcccg

SEQ ID NO: 224957 - DNA, 25 bp, E. coli
caaaagtcatgggatcagcgcggta

SEQ ID NO: 224958 - DNA, 25 bp, E. coli
caaaagtcatggcatcagcgcggta

SEQ ID NO: 224959 - DNA, 25 bp, E. coli
tactcttactattgcgatggtcgcg

SEQ ID NO: 224960 - DNA, 25 bp, E. coli
tactcttactatagcgatggtcgcg

SEQ ID NO: 224961 - DNA, 25 bp, E. coli
tacgtttacagctttgatggcgcgc

SEQ ID NO: 224962 - DNA, 25 bp, E. coli
acagacgttgtctacagcggcgcaa

SEQ ID NO: 224963 - DNA, 25 bp, E. coli
acagacgttgtcaacagcggcgcaa

SEQ ID NO: 224964 - DNA, 25 bp, E. coli
tacgctggcgagattgtgcaaaacc

SEQ ID NO: 224965 - DNA, 25 bp, E. coli
tacgctggcgagtttgtgcaaaacc

SEQ ID NO: 224966 - DNA, 25 bp, E. coli
tacgtttacagcattgatggcgcgc

SEQ ID NO: 224967 - DNA, 25 bp, E. coli
tcacctggcgtgttaaaaacgggct

SEQ ID NO: 224968 - DNA, 25 bp, E. coli
tcacctggcgtgataaaaacgggct

SEQ ID NO: 224969 - DNA, 25 bp, E. coli
gattaactacaagcgtctgcgtctg

SEQ ID NO: 224970 - DNA, 25 bp, E. coli
gattttgccgcacataagtacagcc

SEQ ID NO: 224971 - DNA, 25 bp, E. coli
gattaactacaaccgtctgcgtctg

SEQ ID NO: 224972 - DNA, 25 bp, E. coli
gattttgccgcagataagtacagcc

SEQ ID NO: 224973 - DNA, 25 bp, E. coli
gtgtttgaatctcacggaccgctga

SEQ ID NO: 224974 - DNA, 25 bp, E. coli
gtgtttgaatctgacggaccgctga

SEQ ID NO: 224975 - DNA, 25 bp, E. coli
tggataaccgctgtccggatgaacg

SEQ ID NO: 224976 - DNA, 25 bp, E. coli
tggataaccgctctccggatgaacg
